United States Patent
Walker

(10) Patent No.: US 11,485,775 B2
(45) Date of Patent: Nov. 1, 2022

(54) ANTI-RESPIRATORY SYNCYTIAL VIRUS ANTIBODIES, AND METHODS OF THEIR GENERATION AND USE

(71) Applicant: Adimab, LLC, Lebanon, NH (US)

(72) Inventor: Laura M. Walker, Lebanon, NH (US)

(73) Assignee: Adimab, LLC, Lebanon, NH (US)

( * ) Notice: Subject to any disclaimer, the term of this patent is extended or adjusted under 35 U.S.C. 154(b) by 381 days.

(21) Appl. No.: 16/343,311

(22) PCT Filed: Oct. 20, 2017

(86) PCT No.: PCT/US2017/057737
§ 371 (c)(1),
(2) Date: Apr. 18, 2019

(87) PCT Pub. No.: WO2018/075974
PCT Pub. Date: Apr. 26, 2018

(65) Prior Publication Data
US 2020/0223906 A1  Jul. 16, 2020

Related U.S. Application Data

(60) Provisional application No. 62/411,508, filed on Oct. 21, 2016.

(51) Int. Cl.
*C07K 16/10* (2006.01)
*A61K 39/00* (2006.01)

(52) U.S. Cl.
CPC .... *C07K 16/1027* (2013.01); *A61K 2039/505* (2013.01); *C07K 2317/21* (2013.01); *C07K 2317/33* (2013.01); *C07K 2317/34* (2013.01); *C07K 2317/565* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 5,866,125 A | 2/1999 | Brams et al. | |
| 6,180,370 B1* | 1/2001 | Queen | A61P 31/12 435/69.6 |
| 9,139,642 B2* | 9/2015 | Williamson | A61K 45/06 |
| 2002/0141990 A1* | 10/2002 | Deen | C07K 16/1027 424/133.1 |
| 2016/0024188 A1* | 1/2016 | van den Brink | A61P 31/16 424/139.1 |
| 2018/0025435 A1 | 1/2018 | Karame et al. | |
| 2019/0256580 A1 | 8/2019 | Walker | |
| 2019/0256581 A1 | 8/2019 | Walker | |

FOREIGN PATENT DOCUMENTS

| | | |
|---|---|---|
| JP | 2010-534057 A | 11/2010 |
| JP | 2011-514139 A | 5/2011 |
| JP | 2019-521450 A | 7/2019 |
| WO | WO-2008/106980 A2 | 9/2008 |
| WO | WO-2009/030237 A2 | 3/2009 |
| WO | WO-2014/121021 A1 | 8/2014 |
| WO | WO-2018/075954 A2 | 4/2018 |
| WO | WO-2018/075961 A1 | 4/2018 |
| WO | WO-2018/075974 A2 | 4/2018 |

OTHER PUBLICATIONS

Colman, Peter M. "Effects of amino acid sequence changes on antibody-antigen interactions." Research in Immunology 145.1 (1994): 33-36. (Year: 1994).*
Lubert Stryer, Biochemistry, 4th, WH Freeman, New York (1995) ISBN: 0-7167-2009-4 (Year: 1995).*
Janeway, Charles A. "Immunobiology: The Immune System in Health and Disease." 2005 (Year: 2005).*
Sela-Culang, Inbal, Vered Kunik, and Yanay Ofran. "The structural basis of antibody-antigen recognition." Frontiers in immunology 4 (2013): 302 (Year: 2013).*
Gilman, Morgan S A et al. "Rapid profiling of RSV antibody repertoires from the memory B cells of naturally infected adult donors." Science immunology vol. 1,6 (2016): eaaj1879. doi:10.1126/sciimmunol.aaj1879 (Year: 2016).*
Janeway, Charles A. "Immunobiology: The Immune System in Health and Disease." 2001 (Year: 2001).*
Kipriyanov, Sergey M., and Fabrice Le Gall. "Generation and production of engineered antibodies." Molecular biotechnology 26.1 (2004): 39-60. (Year: 2004).*
Corti, D. et al., Cross-neutralization of four paramyxoviruses by a human monoclonal antibody, Nature, 501(7467):439-443 (2013).
Giersing, B. et al., Meeting report: WHO consultation on Respiratory Syncytial Virus (RSV) vaccine development, Geneva, Apr. 25-26, 2016, Vaccine, 8 pages (2017).
International Search Report for PCT/US2017/057737 (Anti-Respiratory Syncytial Virus Antibodies, and Methods of Their Generation and Use, filed Oct. 20, 2017), issued by ISA/EP, 10 pages (dated Aug. 30, 2018).
McLellan, Jason S., Neutralizing epitopes on the respiratory syncytial virus fusion glycoprotein, Current Opinion in Virology, 11:70-75 (2015).
Ngwuta, J. et al., Prefusion F-specific antibodies determine the magnitude of RSV neutralizing activity in human sera, Science Translational Medicine, 7(309):309ra162-309ra162 (2015).
Schuster, J. et al., A Broadly Neutralizing Human Monoclonal Antibody Exhibits In Vivo Efficacy Against Both Human Metapneumovirus and Respiratory Syncytial Virus, Journal of Infectious Diseases, 211(2):216-225 (2014).
Written Opinion for PCT/US2017/057737 (Anti-Respiratory Syncytial Virus Antibodies, and Methods of Their Generation and Use, filed Oct. 20, 2017), issued by ISA/EP, 14 pages (dated Aug. 30, 2018).
Casset, F. et al., A peptide mimetic of an anti-CD4 monoclonal antibody by rational design, Biochemical and Biophysical Research Communications, 307:198-205 (2003).

(Continued)

*Primary Examiner* — Michael Szperka
*Assistant Examiner* — Lia E Taylor
(74) *Attorney, Agent, or Firm* — Choate, Hall & Stewart LLP; Brenda Herschbach Jarrell; Meaghan E. Bychowski

(57) ABSTRACT

Anti-RSV antibodies with neutralizing potency against RSV subtype A and RSV subtype B are provided, as well as methods for their identification, isolation, generation, and methods for their preparation and use are provided.

9 Claims, 14 Drawing Sheets

Specification includes a Sequence Listing.

(56) References Cited

OTHER PUBLICATIONS

Huang, J. et al., Antibody Epitopes of Pneumovirus Fusion Proteins, Front Immunol., 10:2778, 8 pages (2019).
International Search Report for PCT/US17/57708 (Anti-Respiratory Syncytial Virus Antibodies, and Methods of Their Generation and Use, filed Oct. 20, 2017), issued by ISA/EP, 10 pages (dated Aug. 30, 2018).
International Search Report for PCT/US2017/257720 (Anti-Respiratory Syncytial Virus Antibodies, and Methods of Their Generation and Use, filed Oct. 20, 2017), issued by ISA/EPO, 10 pages (dated Mar. 13, 2018).
Liang, B. et al., Enhanced Neutralizing Antibody Response Induced by Respiratory Syncytial Virus Prefusion F Protein Expressed by a Vaccine Candidate, Journal of Virology, 89(18):9499-9510 (2015).
Liang, B. et al., Packaging and Prefusion Stabilization Separately and Additively Increase the Quantity and Quality of Respiratory Syncytial Virus (RSV)-Neutralizing Antibodies Induced by an RSV Fusion Protein Expressed by a Parainfluenza Virus Vector, Journal of Virology, 90(21):10022-10038 (2016).
Magro, M. et al., Neutralizing antibodies against the preactive form of respiratory syncytial virus fusion protein offer unique possibilities for clinical intervention, Proc Natl Acad Sci USA, 109(8):3089-94 (2012).
Mechelen, L. et al., RSV neutralization by palivizumab, but not by monoclonal antibodies targeting other epitopes, is augmented by Fc gamma receptors, Antiviral Research, 132:1-5 (2016).
Paul, William E., Fundamental Immunology, 3rd Edition, pp. 292-295 (1993).
Raghunandan, R. et al., An insect cell derived respiratory syncytial virus (RSV) F nanoparticle vaccine induces antigenic site II antibodies and protects against RSV challenge in cotton rats by active and passive immunization, Vaccine, 32(48):6485-92 (2014).
Rudikoff, S. et al., Single amino acid substitution altering antigen-binding specificity, Proc. Natl. Acad. Sci. USA, 79:1979-1983 (1982).
Written Opinion for PCT/US17/57708 (Anti-Respiratory Syncytial Virus Antibodies, and Methods of Their Generation and Use, filed Oct. 20, 2017), issued by ISA/EP, 15 pages (dated Aug. 30, 2018).
Written Opinion for PCT/US2017/257720 (Anti-Respiratory Syncytial Virus Antibodies, and Methods of Their Generation and Use, filed Oct. 20, 2017), issued by ISA/EPO, 12 pages (dated Mar. 13, 2018).
McLellan, J. S. et al., Structure of RSV Fusion Glycoprotein Trimer Bound to a Prefusion-Specific Neutralizing Antibody, Science, 340;1113-1117 (2013).

* cited by examiner

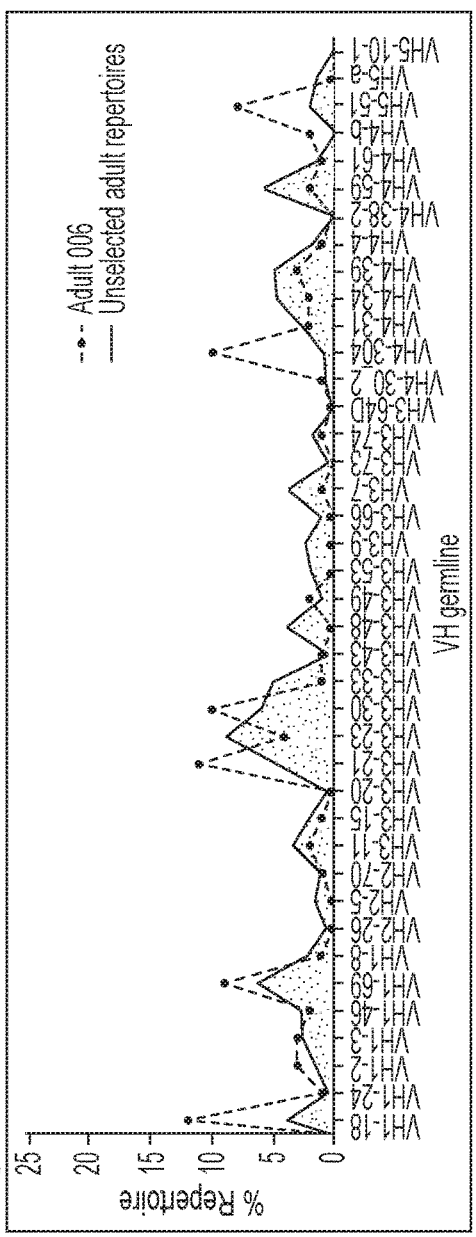
Figure 1C
Figure 1D
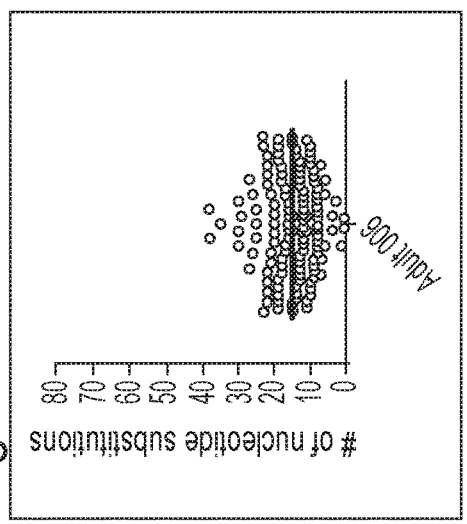
Figure 1F
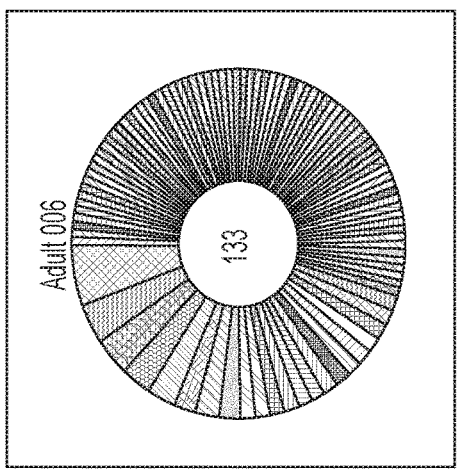
Figure 1E

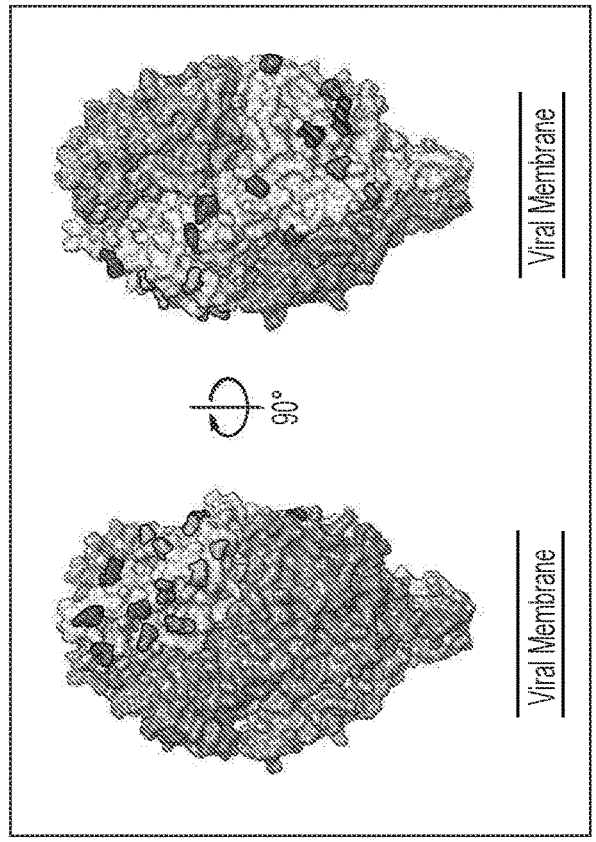
Figure 7A
Figure 7B
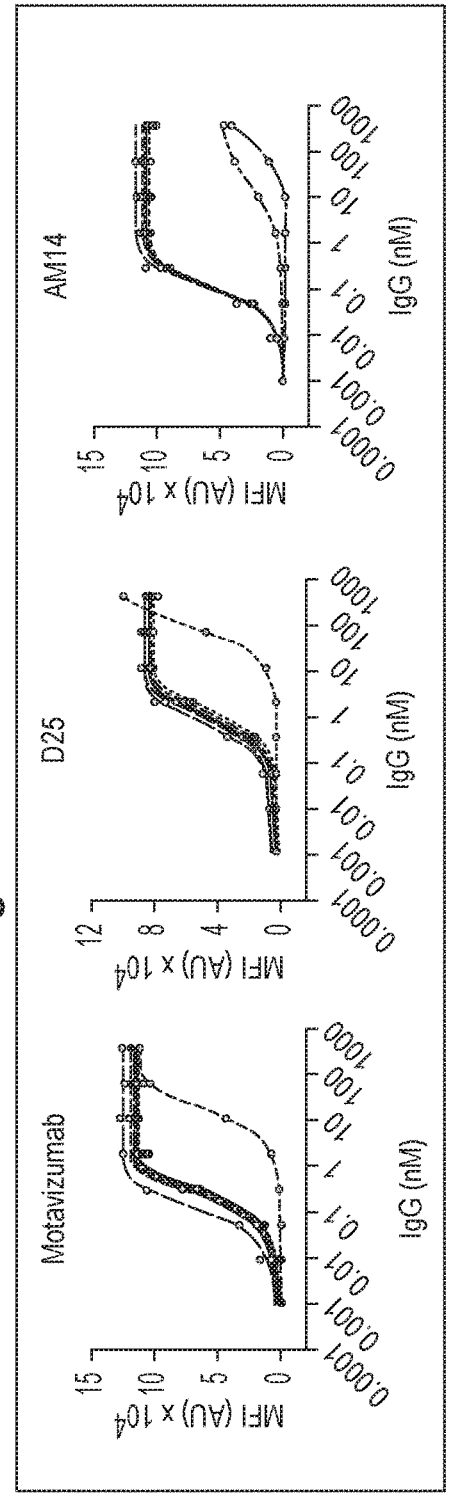
Figure 7C

ANTI-RESPIRATORY SYNCYTIAL VIRUS ANTIBODIES, AND METHODS OF THEIR GENERATION AND USE

CROSS REFERENCE TO RELATED APPLICATIONS

The present application is the National Stage of International Application No. PCT/US2017/057737, filed Oct. 20, 2017, which claims the benefit of U.S. Provisional Patent Application No. 62/411,508, filed Oct. 21, 2016, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Feb. 17, 2022, is named "2009186_0241__SL.TXT" and is 972,588 bytes in size.

FIELD OF THE INVENTION

The invention relates, inter alia, to anti-Respiratory Syncytial Virus (RSV) antibodies and functional fragments thereof, nucleic acid sequences encoding such antibodies and methods and reagents for their preparation and use.

BACKGROUND OF THE INVENTION

All references cited herein, including without limitation patents, patent applications, and non-patent references and publications referenced throughout are hereby expressly incorporated by reference in their entireties for all purposes.

Respiratory syncytial virus (RSV) causes substantial morbidity and mortality in young children and the elderly, is the leading cause of infant hospitalization in the United States and accounts for an estimated 64 million infections and 160,000 deaths world-wide each year. However, despite decades of research, the development of a safe and effective vaccines or therapeutic and/or prophylactic antibodies against RSV has remained elusive, highlighting the need for novel strategies that induce or provide protective immune responses. (1-3). Indeed, to date there are currently no approved RSV vaccines, and passive prophylaxis with the monoclonal antibody palivizumab (marketed as Synagis®) is restricted to high-risk infants in part due to its modest efficacy.

Certain populations of children are at risk for developing an RSV infection and these include preterm infants (Hall et al., 1979, New Engl. J. Med. 300:393-396), children with congenital malformations of the airway, children with bronchopulmonary dysplasia (Groothuis et al., 1988, Pediatrics 82:199-203), children with congenital heart disease (MacDonald et al., New Engl. J. Med. 307:397-400), and children with congenital or acquired immunodeficiency (Ogra et al., 1988, Pediatr. Infect. Dis. J. 7:246-249; and Pohl et al., 1992, J. Infect. Dis. 165:166-169), and cystic fibrosis (Abman et al., 1988, J. Pediatr. 1 13:826-830).

RSV can infect the adult population as well. In this population, RSV causes primarily an upper respiratory tract disease, although elderly patients may be at greater risk for a serious infection and pneumonia (Evans, A. S., eds., 1989, Viral Infections of Humans. Epidemiology and Control, $3^{rd}$ ed., Plenum Medical Book, New York at pages 525-544), as well as adults who are immunosuppressed, particularly bone marrow transplant patients (Hertz et al., 1989, Medicine 68:269-281). Other at risk patients include those suffering from congestive heart failure and those suffering from chronic obstructive pulmonary disease (i.e. COPD). There have also been reports of epidemics among nursing home patients and institutionalized young adults (Falsey, A. R., 1991, Infect. Control Hosp. Epidemiol. 12:602-608; and Garvie et al., 1980, Br. Med. J. 281: 1253-1254).

While treatment options for established RSV disease are limited, more severe forms of the disease of the lower respiratory tract often require considerable supportive care, including administration of humidified oxygen and respiratory assistance (Fields et al., eds, 1990, Fields Virology, $2^{nd}$ ed., Vol. 1, Raven Press, New York at pages 1045-1072).

Similar to other pneumoviruses, RSV expresses two major surface glycoproteins: the fusion protein (F) and the attachment protein (G). Although both have been shown to induce protective neutralizing antibody responses, F is less genetically variable than G, is absolutely required for infection, and is the target for the majority of neutralizing activity in human serum (4-8). RSV F is also the target of the monoclonal antibody palivizumab, which is used to passively protect high-risk infants from severe disease (9). Consequently, the RSV F protein is considered to be a highly attractive target for vaccines and antibody-based therapies.

The mature RSV F glycoprotein initially exists in a metastable prefusion conformation (preF) (10), before undergoing a conformational change that leads to insertion of the hydrophobic fusion peptide into the host-cell membrane. Subsequent refolding of F into a stable, elongated postfusion conformation (postF) (11, 12) results in fusion of the viral and host-cell membranes. Due to its inherent instability, the preF protein has the propensity to prematurely trigger into postF, both in solution and on the viral surface (13). Recently, stabilization of preF has been achieved by protein engineering (14, 15), and stabilized preF has been shown to induce higher titers of neutralizing antibodies than postF in animal models (15).

Despite the importance of neutralizing antibodies in protection against severe RSV disease, our understanding of the human antibody response to RSV has been limited to studies of human sera and a small number of RSV-specific human monoclonal antibodies (16-19). The epitopes recognized by these human antibodies, as well as several murine antibodies, have defined at least four 'antigenic sites' on RSV F (1, 10, 16, 18-20) (see also, e.g, Table 1). Three of these sites—I, II, and IV—are present on both pre- and postF, whereas antigenic site Ø exists exclusively on preF. Additional preF-specific epitopes have been defined by antibodies MPE8 (17) and AM14 (21). Although serum mapping studies have shown that site Ø-directed antibodies are responsible for a large proportion of the neutralizing antibody response in most individuals (8), there are additional antibody specificities that contribute to serum neutralizing activity that remain to be defined. In addition, it was heretofore unknown whether certain antibody sequence features are required for recognition of certain neutralizing sites, as observed for other viral targets (22-25). Accordingly, understanding the relationship between neutralization potency and epitope specificity would be advantageous in the selection and/or design of vaccine antigens, as well as therapeutic and/or prophylactic antibodies, which induce potent neutralizing responses to RSV.

While treatment options for established RSV disease are limited, more severe forms of the disease of the lower respiratory tract often require considerable supportive care, including administration of humidified oxygen and respiratory assistance (Fields et al., eds, 1990, Fields Virology, 2$^{nd}$ ed., Vol. 1, Raven Press, New York at pages 1045-1072).

Ribavirin, which is the only drug approved for treatment of infection, has been shown to be effective in the treatment of pneumonia and bronchiolitis associated with RSV infection, and has been shown to modify the course of severe RSV disease in immunocompetent children (Smith et al., 1991, New Engl. J. Med. 325:24-29). The use of ribavirin is limited due to concerns surrounding its potential risk to pregnant women who may be exposed to the aerosolized drug while it is being administered in a hospital environment.

Similarly, while a vaccine may be useful, no commercially available vaccine has been developed to date. Several vaccine candidates have been abandoned and others are under development (Murphy et al., 1994, Virus Res. 32: 13-36). The development of a vaccine has proven to be problematic. In particular, immunization would be required in the immediate neonatal period since the peak incidence of lower respiratory tract disease occurs at 2-5 months of age. However, it is known that the neonatal immune response is immature at that time. Plus, the infant at that point in time still has high titers of maternally acquired RSV antibody, which might reduce vaccine immunogenicity (Murphy et al., 1988, J. Virol. 62:3907-3910; and Murphy et al., 1991, Vaccine 9:185-189).

Currently, the only approved approach to prophylaxis of RSV disease is passive immunization. For example, the humanized antibody, palivizumab (SYNAGIS®), which is specific for an epitope on the F protein, is approved for intramuscular administration to pediatric patients for prevention of serious lower respiratory tract disease caused by RSV at recommended monthly doses of 15 mg/kg of body weight throughout the RSV season (November through April in the northern hemisphere). SYNAGIS® is a composite of human (95%) and murine (5%) antibody sequences. (Johnson et al., (1997), J. Infect. Diseases 176: 1215-1224 and U.S. Pat. No. 5,824,307).

Although SYNAGIS® has been successfully used for the prevention of RSV infection in pediatric patients, multiple intramuscular doses of 15 mg/kg of SYNAGIS® are required to achieve a prophylactic effect. The necessity for the administration of multiple intramuscular doses of antibody requires repeated visits to the doctor's office, which is not only inconvenient for the patient but can also result in missed doses.

Efforts were made to improve on the therapeutic profile of an anti-RSV-F antibody, and this lead to the identification and development of motavizumab, also referred to as NUMAX™. However, clinical testing revealed that certain of the patients being administered motavizumab were having severe hypersensitivity reactions. Further development of this humanized anti-RSV-F antibody was then discontinued.

Other antibodies to RSV-F protein have been described and can be found in U.S. Pat. Nos. 6,656,467; 5,824,307; 7,786,273; 7,670,600; 7,083,784; 6818216; 7700735; 7553489; 7,323,172; 7,229,619; 7,425,618; 7,740,851; 7,658,921; 7,704,505; 7,635,568; 6,855,493; 6,565,849; 7,582,297; 7,208,162; 7,700,720; 6,413,771; 5,811,524; 6,537,809; 5,762,905; 7,070,786; 7,364,742; 7,879,329; 7,488,477; 7,867,497; 5,534,411; 6,835,372; 7,482,024; 7,691,603; 8,562,996; 8,568,726; 9,447,173; US20100015596; WO2009088159A1; and WO2014159822. To date, none other than SYNAGIS® has been approved by a regulatory agency for use in preventing an RSV infection.

There remains a need for the provision of highly specific, high affinity, and highly potent neutralizing anti-RSV antibodies and antigen-binding fragments thereof with neutralize at least one, but preferably both, of subtype A and subtype B RSV viral strains, and which preferentially recognize PreF relative to PostF conformations of the F protein. There also remains a need for the provision of anti-RSV and anti-HMPV cross-neutralizing antibodies and antigen-binding fragments thereof.

SUMMARY OF THE INVENTION

Applicant has now discovered, isolated, and characterized, inter alia, an extensive panel of RSV F-specific monoclonal antibodies from the memory B cells of a healthy adult human donor and used these antibodies to comprehensively map the antigenic topology of RSV F. A large proportion of the RSV F-specific human antibody repertoire was advantageously comprised of antibodies with greatly enhanced specificity for the PreF conformation of the F protein (relative to the PostF form), many if not most of which exhibited remarkable potency in neutralization assays against one or both of RSV subtype A and RSV subtype B strains. Indeed, a large number of these antibodies display neutralization potencies that are multiple-fold greater— some 5- to 100-fold greater or more—to previous anti-RSV therapeutic antibodies, such as D25 and pavlizumamab thus serve as attractive therapeutic and/or prophylactic candidates for treating and/or preventing RSV infection and disease.

The most potent antibodies were found to target two distinct antigenic sites that are located near the apex of the preF trimer, providing strong support for the development of therapeutic and/or prophylactic antibodies targeting these antigenic sites, as well as preF-based vaccine candidates that preserve these antigenic sites. Furthermore, the neutralizing antibodies described and disclosed herein represent new opportunities for the prevention of severe RSV disease using passive immunoprophylaxis.

Given the role that the F protein plays in fusion of the virus with the cell and in cell to cell transmission of the virus, the antibodies described herein provide a method of inhibiting that process and as such, may be used for preventing infection of a patient exposed to, or at risk for acquiring an infection with RSV, or for treating and/or ameliorating one or more symptoms associated with RSV infection in a patient exposed to, or at risk for acquiring an infection with RSV, or suffering from infection with RSV. The antibodies and pharmaceutical compositions described herein may also be used to prevent or to treat an RSV infection in a patient who may experience a more severe form of the RSV infection due to an underlying or pre-existing medical condition. A patient who may benefit from treatment with an antibody and/or a pharmaceutical composition of the invention may be a preterm infant, a full-term infant born during RSV season (approximately late fall (November) through early spring (April)) that is at risk because of other pre-existing or underlying medical conditions including congenital heart disease or chronic lung disease, a child greater than one year of age with or without an underlying medical condition, an institutionalized or hospitalized patient, or an elderly adult (>65 years of age) with or without an underlying medical condition, such as congestive heart failure (CHF), or chronic obstructive pulmonary disease (COPD). A patient who may benefit from such therapy may suffer from a medical condition resulting from a compromised pulmonary, cardiovascular, neuromuscular, or immune system. For example, the patient may suffer from an abnormality of the airway, or an airway malfunction, a chronic lung disease, a chronic or congenital heart disease, a neuromuscular disease that compromises the handling of respiratory secretions, or the patient may be immunosuppressed due to severe combined immunodeficiency disease or severe acquired immunodeficiency disease, or from any other underlying infectious disease or cancerous condition that results in immunosuppression, or the patient may be immunosuppressed due to treatment with an immunosuppressive drug (e.g. any drug used for treating a transplant patient) or radiation therapy. A patient who may benefit from the antibodies and/or pharmaceutical compositions of the invention may be a patient that suffers from chronic obstructive pulmonary disease (COPD), cystic fibrosis (CF), bronchopulmonary dysplasia, congestive heart failure (CHF), or congenital heart disease.

Because the inventive antibodies and antigen-binding fragments thereof are more effective at neutralization of RSV compared to known antibodies, lower doses of the antibodies or antibody fragments or pharmaceutical compositions of the invention could be used to achieve a greater level of protection against infection with RSV, and more effective treatment and/or amelioration of symptoms associated with an RSV infection. Accordingly, the use of lower doses of antibodies or fragments thereof which immunospecifically bind to RSV-F antigen and/or pharmaceutical compositions may result in fewer or less severe adverse events. Likewise, the use of more effective neutralizing antibodies may result in a diminished need for frequent administration of the antibodies or antibody fragments or pharmaceutical compositions than previously envisioned as necessary for the prevention of infection, or for virus neutralization, or for treatment or amelioration of one or more symptoms associated with an RSV infection. Symptoms of RSV infection may include a bluish skin color due to lack of oxygen (hypoxia), breathing difficulty (rapid breathing or shortness of breath), cough, croupy cough ("seal bark" cough), fever, nasal flaring, nasal congestion (stuffy nose), apnea, decreased appetite, dehydration, poor feeding, altered mental status, or wheezing.

Such antibodies or pharmaceutical compositions may be useful when administered prophylactically (prior to exposure to the virus and infection with the virus) to lessen the severity, or duration of a primary infection with RSV, or ameliorate at least one symptom associated with the infection. The antibodies or pharmaceutical compositions may be used alone or in conjunction with a second agent useful for treating an RSV infection. In certain embodiments, the antibodies or pharmaceutical compositions may be given therapeutically (after exposure to and infection with the virus) either alone, or in conjunction with a second agent to lessen the severity or duration of the primary infection, or to ameliorate at least one symptom associated with the infection. In certain embodiments, the antibodies or pharmaceutical compositions may be used prophylactically as stand-alone therapy to protect patients who are at risk for acquiring an infection with RSV, such as those described above. Any of these patient populations may benefit from treatment with the antibodies or pharmaceutical compositions of the invention, when given alone or in conjunction with a second agent, including for example, an anti-viral therapy, such as ribavirin, or other anti-viral vaccines.

The antibodies of the invention can be full-length (for example, an IgG1 or IgG4 antibody) or may comprise only an antigen-binding portion (for example, a Fab, F(ab')$_2$ or scFv fragment), and may be modified to affect functionality, e.g., to eliminate residual effector functions (Reddy et al., (2000), J. Immunol. 164:1925-1933).

Accordingly, in certain embodiments are provided isolated antibodies or antigen-binding fragments thereof that specifically bind to Respiratory Syncytial Virus (RSV) F protein (F), wherein at least one, at least two, at least three, at least four, at least five, or at least six of the CDRH1, a CDRH2, a CDRH3, a CDRL1, a CDRL2, and CDRL3 amino acid sequence such antibodies or the antigen-binding fragments thereof are at least 70% identical; at least 75% identical; 80% identical; at least 85% identical; at least 90% identical; at least 95% identical; at least 96% identical; at least 97% identical; at least 98% identical; at least 99%; at least 100% and/or all percentages of identity in between; to at least one, at least two, at least three, at least four, at least five, or at least six of the CDRH1, a CDRH2, a CDRH3, a CDRL1, a CDRL2, and/or a CDRL3 amino acid sequences as disclosed in Table 6 of an antibody selected from Antibody Number 232 through Antibody Number 372 as disclosed in Table 6; and wherein said antibody or the antigen-binding fragment thereof also has one or more of the following characteristics: a) the antibodies or antigen-binding fragments thereof cross-compete with said antibodies or antigen-binding fragments thereof for binding to RSV-F; b) the antibodies or antigen-binding fragments thereof display better binding affinity for the PreF form of RSV-F relative to the PostF form; c) the antibodies or antigen-binding fragments thereof display a clean or low polyreactivity profile; d) the antibodies or antigen-binding fragments thereof display neutralization activity toward RSV subtype A and RSV subtype B in vitro; e) the antibodies or antigen-binding fragments thereof display antigenic site specificity for RSV-F at Site Ø, Site I, Site II, Site III, Site IV, or Site V f) the antibodies or antigen-binding fragments thereof display antigenic site specificity for RSV-F Site Ø, Site V, or Site III relative to RSV-F Site I, Site II, or Site IV; g) at least a portion of the epitope with which the antibodies or antigen-binding fragments thereof interact comprises the α3 helix and β3/β4 hairpin of PreF; h) the antibodies or antigen-binding fragments thereof display an in vitro neutralization potency ($IC_{50}$) of between about 0.5 microgram/milliliter (ug/ml) to about 5 ug/ml; between about 0.05 ug/ml to about 0.5 ug/ml; or less than about 0.05 mg/ml; i) the binding affinities and/or epitopic specificities of the antibodies or antigen-binding fragments thereof for any one of the RSV-F variants designated as 1, 2, 3, 4, 5, 6, 7, 8, 9, and DG in FIG. 7A is reduced or eliminated relative to the binding affinities and/or epitopic specificities of said antibodies or antigen-binding fragments thereof for the RSV-F or RSV-F DS-Cav1; j) the antibodies or antigen-binding fragments thereof display a cross-neutralization potency ($IC_{50}$) against human metapneumovirus (HMPV); k) the antibodies or antigen-binding fragments thereof do not complete with D25, MPE8, palivizumab, or motavizumab; or l) the antibodies or antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

In certain other embodiments, the isolated antibodies or antigen-binding fragments thereof comprise: at least two; at least three; at least 4; at least 5; at least 6; at least 7; at least 8; at least 9; at least 10; at least 11; or at least 12; of characteristics a) through 1) above.

In certain other embodiments, the isolated antibodies or antigen-binding fragments thereof comprise: a) the CDRH3 amino acid sequence of any one of the antibodies designated Antibody Number 232 through Antibody Number 372 as disclosed in Table 6; b) the CDRH2 amino acid sequence of any one of the antibodies designated Antibody Number 232 through Antibody Number 372 as disclosed in Table 6; c) the CDRH1 amino acid sequence of any one of the antibodies designated Antibody Number 232 through Antibody Number 372 as disclosed in Table 6; d) the CDRL3 amino acid sequence of any one of the antibodies designated Antibody Number 232 through Antibody Number 372 as disclosed in Table 6; e) the CDRL2 amino acid sequence of any one of the antibodies designated Antibody Number 232 through Antibody Number 372 as disclosed in Table 6; f) the CDRL1 amino acid sequence of any one of the antibodies designated Antibody Number 232 through Antibody Number 372 as disclosed in Table 6; or g) any combination of two or more of a), b), c), d), e), and f).

In certain other embodiments, the isolated antibodies or antigen-binding fragments thereof comprise: a) a heavy chain (HC) amino acid sequence of any one of the antibodies designated Antibody Number 232 through Antibody Number 372 as disclosed in Table 6; and/or b) a light chain (LC) amino acid sequence of any one of the antibodies designated Antibody Number 232 through Antibody Number 372 as disclosed in Table 6.

In certain other embodiments, the isolated antibodies or antigen-binding fragments thereof are selected from the group consisting of antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 232 through Antibody Number 372 as disclosed in Table 6.

In certain other embodiments, the isolated antibodies or antigen-binding fragments thereof are selected from the group consisting of the antibodies designated as Antibody Number 232 through Antibody Number 372 as disclosed in Table 6.

In other embodiments are provided isolated nucleic acid sequences encoding antibodies, light and/or heavy chains thereof, antigen-binding fragments thereof, or light and/or heavy chains encoding such antigen-binding fragments according to any of the other embodiments disclosed herein.

In other embodiments are provided expression vectors comprising isolated nucleic acid sequences according to other embodiments disclosed herein.

In other embodiments are provided host cells transfected, transformed, or transduced with nucleic acid sequences or expression vectors according to other embodiments disclosed herein.

In other embodiments are provided pharmaceutical compositions comprising one or more of the isolated antibodies or antigen-binding fragments thereof according to other embodiments disclosed herein; and a pharmaceutically acceptable carrier and/or excipient.

In other embodiments are provided pharmaceutical compositions comprising a nucleic acid sequence of the invention, e.g., one or more nucleic acid sequences encoding at least one of a light or heavy chain of an antibody or both according other embodiments disclosed herein; or one or more expression vectors according to other embodiments disclosed herein; and a pharmaceutically acceptable carrier and/or excipient.

In other embodiments are provided transgenic organisms comprising nucleic acid sequences according to other embodiments disclosed herein; or expression vectors according to other embodiments disclosed herein.

In other embodiments are provided methods of treating or preventing a Respiratory Syncytial Virus (RSV) infection, or at least one symptom associated with RSV infection, comprising administering to a patient in need there of or suspected of being in need thereof: a) one or more antibodies or antigen-binding fragments thereof according to other embodiments disclosed herein; b) nucleic acid sequences according to other embodiments disclosed herein; an expression vector according to other embodiments disclosed herein; a host cell according to other embodiments disclosed herein; or e) a pharmaceutical composition according to other embodiments disclosed herein; such that the RSV infection is treated or prevented, or the at least on symptom associated with RSV infection is treated, alleviated, or reduced in severity.

In other embodiments are provided methods of treating or preventing either a Respiratory Syncytial Virus (RSV) infection and/or a human metapneumovirus (HMPV) infection, or at least one symptom associated with said RSV infection or said HMPV infection, comprising administering to a patient in need thereof or suspected of being in need thereof: a) one or more antibodies or antigen-binding fragments thereof according to other embodiments disclosed herein; b) a nucleic acid sequences according to other embodiments disclosed herein; c) an expression vector according to other embodiments disclosed herein; d) a host cell according to other embodiments disclosed herein; or e) a pharmaceutical composition according to other embodiments disclosed herein; such that the RSV infection is treated or prevented, or the at least on symptom associated with RSV infection is treated, alleviated, or reduced in severity. In other embodiments are provided methods according to other embodiments wherein the one or more antibodies or antigen-binding fragments thereof of a) is selected from the group consisting of the antibodies designated as Antibody Number 340 as disclosed in Table 6.

In other embodiments are provided methods according to other embodiments wherein the method further comprises administering to the patient a second therapeutic agent.

In other embodiments are provided methods according to other embodiments, wherein the second therapeutic agent is selected group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

In certain embodiments are provided pharmaceutical compositions comprising any one or more of the isolated antibodies or antigen-binding fragments thereof, or one or more nucleic acid sequences encoding at least one of a light chain or heavy chain of an antibody according to other embodiments disclosed herein or an antigen binding fragment thereof, and a pharmaceutically acceptable carrier and/or excipient.

In certain embodiments are provided pharmaceutical compositions according to other embodiments for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

In certain embodiments are provided pharmaceutical compositions according to other embodiments for use in treating or preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection is either prevented, or at least one symptom or complication associated with the infection is prevented, ameliorated, or lessened in severity and/or duration as a result of such use.

In certain other embodiments are provided uses of the pharmaceutical compositions according to other embodiments in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

In certain other embodiments are provided uses of the pharmaceutical compositions according to other embodiments in the manufacture of a medicament for preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection is either prevented, or at least one symptom or complication associated with the infection is prevented, ameliorated, or lessened in severity and/or duration as a result of such use.

BRIEF DESCRIPTION OF THE FIGURES

FIGS. 1A-1F illustrate the anti-RSV repertoire cloning and sequence analysis of the identified and isolated antibodies. FIG. 1A: RSV F-specific B cell sorting. FACS plots show RSV F reactivity of IgG+ and IgA+ B cells from the healthy adult donor. B cells in quadrant 2 (Q2) were single cell sorted. FIG. 1B: Isotype analysis. Index sort plots show the percentage of RSV F-specific B cells that express IgG or IgA. FIG. 1C: Clonal lineage analysis. Each slice represents one clonal lineage; the size of the slice is proportional to the number of clones in the lineage. The total number of clones is shown in the center of the pie. Clonal lineages were assigned based on the following criteria: 1) matching of variable and joining gene segments; 2) identical CDR3 loop lengths; and 3) >80% homology in CDR3 nucleotide sequences. FIG. 1D: VH repertoire analysis. VH germline genes were considered to be enriched in the RSV repertoire if a given gene was found to be enriched by greater than 3-fold over non-RSV-specific repertoires (33). FIG. 1E: CDRH3 length distribution. FIG. 1F: Somatic hypermutation in VH (excluding CDRH3). Red bars indicate the average number of nucleotide substitutions. Each clonal lineage is only represented once in FIG. 1D and FIG. 1E. Data for non-RSV reactive IgGs were derived from published sequences obtained by high-throughput sequencing of re-arranged antibody variable gene repertoires from healthy individuals (33).

FIG. 2A: IgG affinities for preF and postF are plotted as shown. FIG. 2B: Percentage of antibodies within the donor repertoire that recognized both conformations of F (green) or bind only to preF (blue) or postF (orange). FIG. 2C: Percentage of antibodies within the donor repertoire that bind specifically to subtype A (green), subtype B (blue), or both subtypes A and B (red). N.B., non-binder. IgG KDs were calculated for antibodies with BLI responses >0.1 nm. Antibodies with BLI responses <0.05 nm were designated as N.B. FIG. 2D: Polyreactivity analysis of anti-RSV antibodies. The polyreactivity of the isolated anti-RSV F antibodies was measured using a previously described assay (42, 43). Three panels of control antibodies were included for comparison: a group of 138 antibodies currently in clinical trials, 39 antibodies that have been approved for clinical use and 14 broadly neutralizing HIV antibodies.

FIG. 3A: The previously determined structure of preF with one protomer shown as ribbons and with six antigenic sites rainbow colored from red to purple. FIG. 3B: The percentage of antibodies targeting each antigenic site is shown. FIG. 3C: Percentage of preF-specific antibodies targeting each antigenic site. FIG. 3D: Apparent antibody binding affinities for subtype A PreF antigenic sites. FIG. 3E: Apparent binding affinities for subtype A postF antigenic sites. FIG. 3F: Apparent antibody binding affinities for subtype B PreF antigenic sites. FIG. 3G. Apparent binding affinities for subtype B postF. Only antibodies with apparent binding affinities greater than 2 nM were included in this analysis, since antibodies with lower affinity could not be reliably mapped. Red bars show the median and the dotted grey line is at 2 nM. N.B., non-binder.

FIG. 4A: Neutralization $IC_{50}$s for the antibodies isolated from the donor repertoire. Data points are colored based on neutralization potency, according to the legend on the right. Red and blue dotted lines depict motavizumab and D25 $IC_{50}$s, respectively. FIG. 4B: Percentage of neutralizing antibodies in the donor repertoire against RSV subtype A or subtype B, stratified by potency as indicated in the legend in the right portion of the figure. FIG. 4C: Percentage of antibodies within the donor repertoire that neutralized both RSV subtypes A and B (red) or neutralized only RSV subtype A (green) or subtype B (blue). FIG. 4D: Apparent binding affinities for subtype A, preF and postF, plotted for each antibody (IgG KDs were calculated for antibodies with BLI responses >0.1 nm. Antibodies with BLI responses <0.05 nm were designated as N.B.) FIG. 4E: Neutralization $IC_{50}$s plotted for RSV subtype A preF-specific, postF-specific, and cross-reactive antibodies. (Red and blue dotted lines depict motavizumab and D25 $IC_{50}$s, respectively. Red bars depict median. N.B., non-binder; N.N., non-neutralizing). FIG. 4F: Apparent antibody binding affinities for subtype B, preF and postF. FIG. 4G: $IC_{50}$s plotted for RSV subtype B preF-specific, postF-specific and cross-reactive antibodies. (Black bar depicts median. N.B., non-binder; N.N., non-neutralizing.)

FIG. 5A: apparent preF $K_D$ plotted against neutralization $IC_{50}$ and colored according to antigenic site, as shown in the legend at right of FIG. 5C. FIG. 5B: apparent postF $K_D$ plotted against neutralization $IC_{50}$ and colored as in FIG. 5A. FIG. 5C: antib acquire adaptive mutations that may affect their biological properties. A "clinical strain" as used herein refers to an RSV isolate (subtype A or B), which is obtained from an infected individual and which has been isolated and grown in tissue culture at low passage.

Figure 1A:
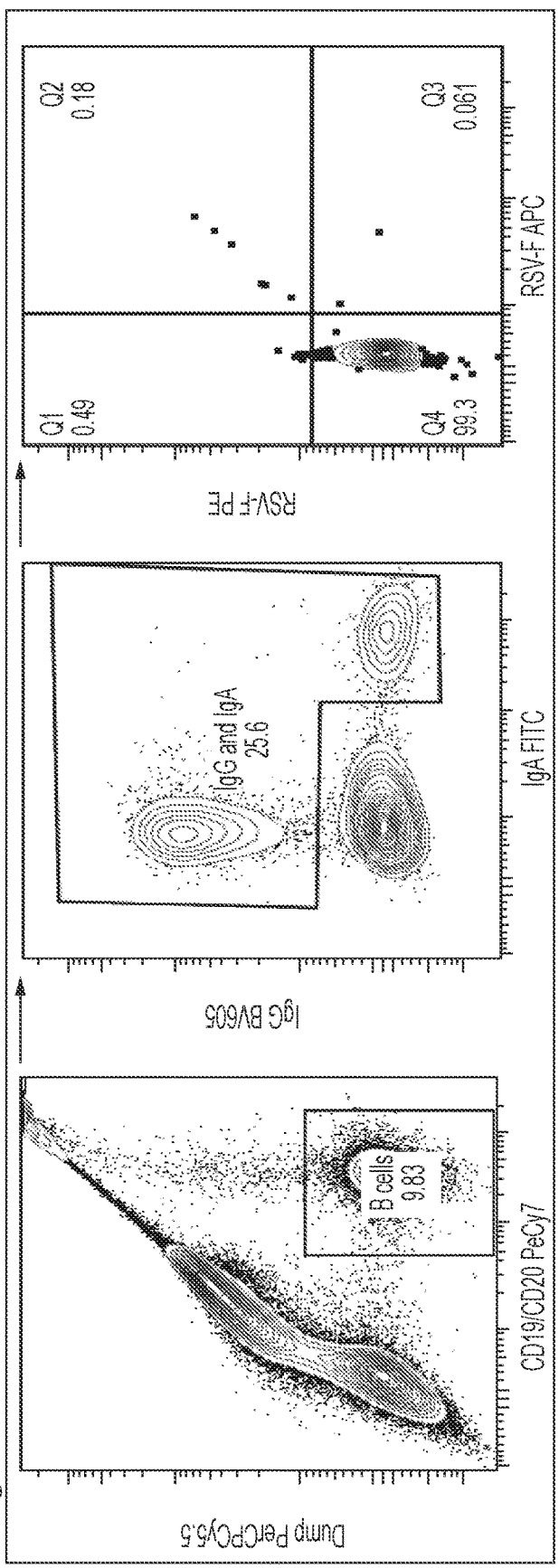

The term "effective dose 99" or "$ED_{99}$" refers to the dosage of an agent that produces a desired effect of 99% reduction of viral forming plaques relative to the isotype (negative) control. In the present invention, the $ED_{99}$ refers to the dosage of the anti-RSV-F antibodies that will neutralize the virus infection (e.g., reduce 99% of viral load) in vivo, as described in Example 5.

The term "$IC_{50}$" refers to the "half maximal inhibitory concentration", which value measures the effectiveness of compound (e.g., anti-RSV-F antibody) inhibition towards a biological or biochemical utility. This quantitative measure indicates the quantity required for a particular inhibitor to inhibit a given biological process by half. In certain embodiments, RSV virus neutralization potencies for anti-RSV and/or anti-RSV/anti-HMPV cross-neutralizing antibodies disclosed herein are expressed as neutralization $IC_{50}$ values.

"Palivizumab", also referred to as "SYNAGIS®", is a humanized anti-RSV-F antibody with heavy and light chain variable domains having the amino acid sequences as set forth in U.S. Pat. Nos. 7,635,568 and 5,824,307. This antibody, which immunospecifically binds to the RSV-F protein, is currently FDA-approved for the passive immunoprophylaxis of serious RSV disease in high-risk children and is administered intramuscularly at recommended monthly doses of 15 mg/kg of body weight throughout the RSV season (November through April in the northern hemisphere). SYNAGIS® is composed of 95% human and 5% murine antibody sequences. See also Johnson et al., (1997), J. Infect. Diseases 176:1215-1224.

"Motavizumab", also referred to as "NUMAX™", is an enhanced potency RSV-F-specific humanized monoclonal antibody derived by in vitro affinity maturation of the complementarity—determining regions of the heavy and light chains of palivizumab. For reference purposes, the amino acid sequence of the NUMAX™ antibody is disclosed in U.S Patent Publication 2003/0091584 and in U.S. Pat. No. 6,818,216 and in Wu et al., (2005) J. Mol. Bio. 350(1):126-144 and in Wu, et al. (2007) J. Mol. Biol. 368:652-665. It is also shown herein as SEQ ID NO: 359 for the heavy chain and as SEQ ID NO: 360 for the light chain of the antibody.

As used herein, the terms "treat," "treatment" and "treating" refer to the reduction or amelioration of the progression, severity, and/or duration of an upper and/or lower respiratory tract RSV infection and/or human metapneumovirus (HMPV), otitis media, or a symptom or respiratory condition related thereto (such as asthma, wheezing, or a combination thereof) resulting from the administration of one or more therapies (including, but not limited to, the administration of one or more prophylactic or therapeutic agents). In certain embodiments, such terms refer to the reduction or inhibition of the replication of RSV and/or HMPV, the inhibition or reduction in the spread of RSV and/or HMPV to other tissues or subjects (e.g., the spread to the lower respiratory tract), the inhibition or reduction of infection of a cell with a RSV and/or HMPV, or the amelioration of one or more symptoms associated with an upper and/or lower respiratory tract RSV infection or otitis media.

As used herein, the terms "prevent," "preventing," and "prevention" refer to the prevention or inhibition of the development or onset of an upper and/or lower respiratory tract RSV and/or HMPV infection, otitis media or a respiratory condition related thereto in a subject, the prevention or inhibition of the progression of an upper respiratory tract RSV and/or HMPV infection to a lower respiratory tract RSV and/or HMPV infection, otitis media or a respiratory condition related thereto resulting from the administration of a therapy (e.g., a prophylactic or therapeutic agent), the prevention of a symptom of an upper and/or lower tract RSV and/or HMPV infection, otitis media or a respiratory condition related thereto, or the administration of a combination of therapies (e.g., a combination of prophylactic or therapeutic agents). As used herein, the terms "ameliorate" and "alleviate" refer to a reduction or diminishment in the severity a condition or any symptoms thereof.

The term "antibody", as used herein, is intended to refer to immunoglobulin molecules comprised of four polypeptide chains, two heavy (H) chains and two light (L) chains interconnected by disulfide bonds (i.e., "full antibody molecules"), as well as multimers thereof (e.g. IgM) or antigen-binding fragments thereof. Each heavy chain (HC) is comprised of a heavy chain variable region ("HCVR" or "$V_H$") and a heavy chain constant region (comprised of domains $C_H1$, $C_H2$ and $C_H3$). Each light chain (LC) is comprised of a light chain variable region ("LCVR or "$V_L$") and a light chain constant region ($C_L$). The $V_H$ and $V_L$ regions can be further subdivided into regions of hypervariability, termed complementarity determining regions (CDRs), interspersed with regions that are more conserved, termed framework regions (FRs). Each $V_H$ and $V_L$ is composed of three CDRs and four FRs, arranged from amino-terminus to carboxy-terminus in the following order: FR, CDR1, FR2, CDR2, FR3, CDR3, FR4. In certain embodiments of the invention, the FRs of the antibody (or antigen binding fragment thereof) may be identical to the human germline sequences, or may be naturally or artificially modified. An amino acid consensus sequence may be defined based on a side-by-side analysis of two or more CDRs. Accordingly, the CDRs in a heavy chain are designated "CHRH1", "CDRH2", and "CDRH3", respectively, and the CDRs in a light chain are designated "CDRL1", "CDRL2", and "CDRL3".

Substitution of one or more CDR residues or omission of one or more CDRs is also possible. Antibodies have been described in the scientific literature in which one or two CDRs can be dispensed with for binding. Padlan et al. (1995 FASEB J. 9:133-139) analyzed the contact regions between antibodies and their antigens, based on published crystal structures, and concluded that only about one fifth to one third of CDR residues actually contact the antigen. Padlan also found many antibodies in which one or two CDRs had no amino acids in contact with an antigen (see also, Vajdos et al. 2002 J Mol Biol 320:415-428).

CDR residues not contacting antigen can be identified based on previous studies (for example residues H60-H65 in CDRH2 are often not required), from regions of Kabat CDRs lying outside Chothia CDRs, by molecular modeling and/or empirically. If a CDR or residue(s) thereof is omitted, it is usually substituted with an amino acid occupying the corresponding position in another human antibody sequence or a consensus of such sequences. Positions for substitution within CDRs and amino acids to substitute can also be selected empirically.

The fully human monoclonal antibodies disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes fully monoclonal antibodies comprising variants of any of the CDR amino acid sequences disclosed herein having one or more conservative substitutions. For example, the present invention includes antibodies having CDR amino acid sequences with, e.g., 10 or fewer, 8 or fewer, 6 or fewer, 4 or fewer, etc. conservative amino acid substitutions relative to any of the CDR amino acid sequences disclosed herein.

The term "human antibody", as used herein, is intended to include antibodies having variable and constant regions derived from human germline immunoglobulin sequences. The human mAbs of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include mAbs in which CDR sequences derived from the germline of another mammalian species (e.g., mouse), have been grafted onto human FR sequences.

The term "humanized antibody" refers to human antibody in which one or more CDRs of such antibody have been replaced with one or more corresponding CDRs obtained a non-human derived (e.g., mouse, rat, rabbit, primate) antibody. Humanized antibodies may also include certain non-CDR sequences or residues derived from such non-human antibodies as well as the one or more non-human CDR sequence. Such antibodies may also be referred to as "chimeric antibodies".

The term "recombinant" generally refers to any protein, polypeptide, or cell expressing a gene of interest that is produced by genetic engineering methods. The term "recombinant" as used with respect to a protein or polypeptide, means a polypeptide produced by expression of a recombinant polynucleotide. The proteins used in the immunogenic compositions of the invention may be isolated from a natural source or produced by genetic engineering methods.

The antibodies of the invention may, in some embodiments, be recombinant human antibodies. The term "recombinant human antibody", as used herein, is intended to include all antibodies, including human or humanized antibodies, that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The term "specifically binds," or "binds specifically to", or the like, means that an antibody or antigen-binding fragment thereof forms a complex with an antigen that is relatively stable under physiologic conditions. Specific binding can be characterized by an equilibrium dissociation constant of at least about $1 \times 10^{-6}$ M or less (e.g., a smaller $K_D$ denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, biolayer interferometry measurements using, e.g., a ForteBio Octet HTX instrument (Pall Life Sciences), which bind specifically to RSV-F. Moreover, multi-specific antibodies that bind to RSV-F protein and one or more additional antigens, such as an antigen expressed by HMPV, or a bi-specific that binds to two different regions of RSV-F are nonetheless considered antibodies that "specifically bind", as used herein. In certain embodiments, the antibodies disclosed herein display equilibrium dissociation constants (and hence specificities) of about $1 \times 10^{-6}$ M; about $1 \times 10^{-7}$ M; about $1 \times 10^{-8}$ M; about $1 \times 10^{-9}$ M; about $1 \times 10^{-10}$ M; between about $1 \times 10^{-6}$ M and about $1 \times 10^{-7}$ M;

between about $1 \times 10^{-7}$ M and about $1 \times 10^{-8}$ M; between about $1 \times 10^{-8}$ M and about $1 \times 10^{-9}$ M; or between about $1 \times 10^{-9}$ M and about $1 \times 10^{-10}$ M.

The term "high affinity" antibody refers to those mAbs having a binding affinity to RSV-F and/or HMPV, expressed as $K_D$, of at least $10^{-9}$ M; more preferably $10^{-10}$M, more preferably $10^{-11}$M, more preferably $10^{-12}$M as measured by surface plasmon resonance, e.g., BIACORE™, biolayer interferometry measurements using, e.g., a ForteBio Octet HTX instrument (Pall Life Sciences), or solution-affinity ELISA.

By the term "slow off rate", "Koff" or "kd" is meant an antibody that dissociates from RSV-F, with a rate constant of $1 \times 10^{-3}$ s$^{-1}$ or less, preferably $1 \times 10^{-4}$ s$^{-1}$ or less, as determined by surface plasmon resonance, e.g., BIACORE™ or a ForteBio Octet HTX instrument (Pall Life Sciences).

The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. In certain embodiments, the terms "antigen-binding portion" of an antibody, or "antibody fragment", as used herein, refers to one or more fragments of an antibody that retains the ability to bind to RSV-F and/or HMPV.

An antibody fragment may include a Fab fragment, a F(ab')$_2$ fragment, a Fv fragment, a dAb fragment, a fragment containing a CDR, or an isolated CDR. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_h1$-$C_h2$; (v) $V_H$-$C_h1$-$C_h2$-$C_h3$; (vi) $V_H$-$C_H2$-$C_H3$; (vii) $V_H$-$C_L$; $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or heterodimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody will typically comprise at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art.

The specific embodiments, antibody or antibody fragments of the invention may be conjugated to a therapeutic moiety ("immunoconjugate"), such as an antibiotic, a second anti-RSV-F antibody, an anti-HMPV antibody, a vaccine, or a toxoid, or any other therapeutic moiety useful for treating an RSV infection and/or an HMPV infection.

An "isolated antibody", as used herein, is intended to refer to an antibody that is substantially free of other antibodies (Abs) having different antigenic specificities (e.g., an isolated antibody that specifically binds RSV-F and/or HMPV, or a fragment thereof, is substantially free of Abs that specifically bind antigens other than RSV-F and/or HMPV.

A "blocking antibody" or a "neutralizing antibody", as used herein (or an "antibody that neutralizes RSV-F and/or HMPV activity"), is intended to refer to an antibody whose binding to RSV-F or to an HMPV antigen, as the case may be as disclosed herein, results in inhibition of at least one biological activity of RSV-F and/or HMPV. For example, an antibody of the invention may aid in blocking the fusion of RSV and/or HMPV to a host cell, or prevent syncytia formation, or prevent the primary disease caused by RSV and/or HMPV. Alternatively, an antibody of the invention may demonstrate the ability to ameliorate at least one symptom of the RSV infection and or HMPV infection. This inhibition of the biological activity of RSV-F and/or HMPV can be assessed by measuring one or more indicators of RSV-F and/or HMPV biological activity by one or more of several standard in vitro assays (such as a neutralization assay, as described herein) or in vivo assays known in the art (for example, animal models to look at protection from challenge with RSV and/or HMPV following administration of one or more of the antibodies described herein).

The term "surface plasmon resonance", as used herein, refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.).

The term "$K_D$", as used herein, is intended to refer to the equilibrium dissociation constant of a particular antibody-antigen interaction.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The term "substantial identity", or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. Accordingly, nucleic acid sequences that display a certain percentage "identity" share that percentage identity, and/or are that percentage "identical" to one another. A nucleic acid molecule having substantial identity to a reference nucleic acid molecule may, in certain instances, encode a polypeptide having the same or substantially similar amino acid sequence as the polypeptide encoded by the reference nucleic acid molecule.

In certain embodiments, the disclosed antibody nucleic acid sequences are, e.g., at least 70% identical; at least 75% identical; at least 80% identical; at least 85% identical; at least 90% identical; at least 95% identical; at least 96% identical; at least 97% identical; at least 98% identical; at least 99% identical; or 100% identical; and/or all percentages of identity in between; to other sequences and/or share such percentage identities with one another (or with certain subsets of the herein-disclosed antibody sequences).

As applied to polypeptides, the term "substantial identity" or "substantially identical" means that two peptide sequences, when optimally aligned, such as by the programs GAP or BESTFIT using default gap weights, share at least 90% sequence identity, even more preferably at least 95%, 98% or 99% sequence identity. Accordingly, amino acid sequences that display a certain percentage "identity" share that percentage identity, and/or are that percentage "identical" to one another. Accordingly, amino acid sequences that display a certain percentage "identity" share that percentage identity, and/or are that percentage "identical" to one another.

In certain embodiments, the disclosed antibody amino acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to other sequences and/or share such percentage identities with one another (or with certain subsets of the herein-disclosed antibody sequences).

Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. (See, e.g., Pearson (1994) Methods Mol. Biol. 24: 307-331). Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA {e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. (See, e.g., Altschul et al. (1990) J. Mol. Biol. 215: 403 410 and (1997) Nucleic Acids Res. 25:3389 402).

In certain embodiments, the antibody or antibody fragment for use in the method of the invention may be monospecific, bi-specific, or multi-specific. Multi-specific antibodies may be specific for different epitopes of one target polypeptide or may contain antigen-binding domains specific for epitopes of more than one target polypeptide. An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise an Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 mAbs; N44S, K52N, and V82I (IMGT; N384S, K392N, and V422I by EU) in the case of IgG2 mAbs; and Q15R, N44S, K52N, V57M, R69K, E79Q, and V82I (by IMGT; Q355R, N384S, K392N, V397M, R409K, E419Q, and V422I by EU) in the case of IgG4 mAbs. Variations on the bi-specific antibody format described above are contemplated within the scope of the present invention.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

An "immunogenic composition" relates to a composition containing an antigen/immunogen, e.g., a microorganism, such as a virus or a bacterium, or a component thereof, a protein, a polypeptide, a fragment of a protein or polypeptide, a whole cell inactivated, subunit or attenuated virus, or a polysaccharide, or combination thereof, administered to stimulate the recipient's humoral and/or cellular immune systems to one or more of the antigens/immunogens present in the immunogenic composition. The immunogenic compositions of the present invention can be used to treat a human susceptible to RSV and/or HMPV infection or suspected of having or being susceptible to RSV and/or HMPV infection, by means of administering the immunogenic compositions via a systemic route. These administrations can include injection via the intramuscular (i.m.), intradermal (i.d.), intranasal or inhalation route, or subcutaneous (s.c.) routes; application by a patch or other transdermal delivery device. In one embodiment, the immunogenic composition may be used in the manufacture of a vaccine or in the elicitation of polyclonal or monoclonal antibodies that could be used to passively protect or treat a mammal.

The terms "vaccine" or "vaccine composition", which are used interchangeably, refer to a composition comprising at least one immunogenic composition that induces an immune response in an animal.

In certain embodiments, a protein of interest comprises an antigen. The terms "antigen," "immunogen," "antigenic," "immunogenic," "antigenically active," and "immunologically active" when made in reference to a molecule, refer to any substance that is capable of inducing a specific humoral and/or cell-mediated immune response. In one embodiment, the antigen comprises an epitope, as defined above.

"Immunologically protective amount", as used herein, is an amount of an antigen effective to induce an immunogenic response in the recipient that is adequate to prevent or ameliorate signs or symptoms of disease, including adverse health effects or complications thereof. Either humoral immunity or cell-mediated immunity or both can be induced. The immunogenic response of an animal to a composition can be evaluated, e.g., indirectly through measurement of antibody titers, lymphocyte proliferation assays, or directly through monitoring signs and symptoms after challenge with the microorganism. The protective immunity conferred by an immunogenic composition or vaccine can be evaluated by measuring, e.g., reduction of shed of challenge organisms, reduction in clinical signs such as mortality, morbidity, temperature, and overall physical condition, health and performance of the subject. The immune response can comprise, without limitation, induction of cellular and/or humoral immunity. The amount of a composition or vaccine that is therapeutically effective can vary, depending on the particular organism used, or the condition of the animal being treated or vaccinated.

An "immune response", or "immunological response" as used herein, in a subject refers to the development of a humoral immune response, a cellular-immune response, or a humoral and a cellular immune response to an antigen/immunogen. A "humoral immune response" refers to one that is at least in part mediated by antibodies. A "cellular immune response" is one mediated by T-lymphocytes or other white blood cells or both, and includes the production of cytokines, chemokines and similar molecules produced by activated T-cells, white blood cells, or both. Immune responses can be determined using standard immunoassays and neutralization assays, which are known in the art.

"Immunogenicity", as used herein, refers to the capability of a protein or polypeptide to elicit an immune response directed specifically against a bacteria or virus that causes the identified disease.

Unless specifically indicated otherwise, the term "antibody," as used herein, shall be understood to encompass antibody molecules comprising two immunoglobulin heavy chains and two immunoglobulin light chains (i.e., "full antibody molecules") as well as antigen-binding fragments thereof. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex.

Preparation of Human Antibodies

As disclosed herein, anti-RSV and or anti-RSV/anti-HMPF cross neutralizing antibodies by be obtained through B cell sorting techniques available to the artisan, and, for example, as described in the EXAMPLES below. Methods for generating human antibodies in transgenic mice are also known in the art and may be employed in order to derive antibodies in accordance with the present disclosure. Any such known methods can be used in the context of the present invention to make human antibodies that specifically bind to RSV-F (see, for example, U.S. Pat. No. 6,596,541).

In certain embodiments, the antibodies of the instant invention possess affinities ($K_D$) ranging from about $1.0 \times 10^{-7}$M to about $1.0 \times 10^{-12}$M, when measured by binding to antigen either immobilized on solid phase or in solution phase. In certain embodiments, the antibodies of the invention possess affinities ($K_D$) ranging from about $1 \times 10^{-7}$ M to about $6 \times 10^{-10}$ M, when measured by binding to antigen either immobilized on solid phase or in solution phase. In certain embodiments, the antibodies of the invention possess affinities ($K_D$) ranging from about $1 \times 10^{-7}$ M to about $9 \times 10^{-10}$ M, when measured by binding to antigen either immobilized on solid phase or in solution phase.

The anti-RSV-F and/or anti-HMPV antibodies and antibody fragments disclosed herein encompass proteins having amino acid sequences that vary from those of the described antibodies, but that retain the ability to bind RSV-F. Such variant antibodies and antibody fragments comprise one or more additions, deletions, or substitutions of amino acids when compared to parent sequence, but exhibit biological activity that is essentially equivalent to that of the described antibodies. Likewise, the antibody-encoding DNA sequences of the present invention encompass sequences that comprise one or more additions, deletions, or substitutions of nucleotides when compared to the disclosed sequence, but that encode an antibody or antibody fragment that is essentially bioequivalent to an antibody or antibody fragment of the invention.

Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antibodies will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and/or in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antibody.

Bioequivalent variants of the antibodies of the invention may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antibodies may include antibody variants comprising amino acid changes, which modify the glycosylation characteristics of the antibodies, e.g., mutations that eliminate or remove glycosylation.

Biological and Biophysical Characteristics of the Antibodies

In certain embodiments, the inventive antibodies and antigen-binding fragments thereof specifically bind to Respiratory Syncytial Virus (RSV) F protein (F), wherein at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or 100% identical, and/or all percentages of identity in between; to at least one of the CDRH1, a CDRH2, a CDRH3, a CDRL1, a CDRL2, and/or a CDRL3 amino acid sequences as disclosed in Table 6 of an antibody selected from Antibody Number 232 through Antibody Number 372 as disclosed in Table 6. In certain embodiments, such antibodies also possess at least one, two, three, four, five, six, seven, eight, nine, ten, or more characteristics disclosed in the immediately following eleven paragraphs.

Without wishing to be bound by any theory, it is believed that the inventive antibodies and antigen-binding fragments thereof may function by binding to RSV-F, preferably in the PreF conformation, and in so doing act to block the fusion of the viral membrane with the host cell membrane. The antibodies of the present invention may also function by binding to RSV-F and in so doing block the cell to cell spread of the virus and block syncytia formation associated with RSV infection of cells. Advantageously, both RSV subtype A and RSV subtype B are effectively blocked, or neutralized, by the majority of the anti-RSV antibodies disclosed herein.

In certain embodiments, the inventive antibodies and antigen-binding fragment thereof display better binding affinity for the PreF form of RSV-F relative to the PostF form of RSV-F.

In certain other embodiments, the inventive antibodies and antigen-binding fragments thereof advantageously display a clean or low polyreactivity profile (see, e.g., WO 2014/179363 and Xu et al., *Protein Eng Des Sel*, October; 26(10):663-70), and are thus particularly amenable to development as safe, efficacious, and developable therapeutic and/or prophylactic anti-RSV and/or HMPV treatments.

In certain embodiments, the inventive antibodies and antigen-binding fragments thereof, without wishing to be bound by any theory, may function by blocking or inhibiting RSV fusion to the cell membrane by binding to any one or more of, e.g., antigenic Sites Ø, I, II, III, IV, or Site V of the PreF conformation of the F protein. In certain embodiments, the inventive antibodies display antigenic site specificity for Site Ø, Site V, or Site III of PreF relative to RSV-F Site I, Site II, or Site IV.

In certain embodiments, at least a portion of the epitope with which the inventive antibodies and antigen-binding fragments thereof interacts comprises a portion of the α3 helix and β3/β4 hairpin of PreF. In certain embodiments, substantially all of the epitope of such antibodies comprises the α3 helix and β3/β4 hairpin of PreF. In still further embodiments, the inventive antibodies cross-compete with antibodies that recognize a portion or substantially all of the α3 helix and β3/β4 hairpin of PreF.

In certain embodiments, the inventive antibodies and antigen-binding fragments thereof display an in vitro neutralization potency ($IC_{50}$) of between about 0.5 microgram/milliliter (ug/ml) to about 5 ug/ml; between about 0.05 ug/ml to about 0.5 ug/ml; or less than about 0.05 mg/ml.

In certain embodiments, the binding affinity and/or epitopic specificity of the inventive antibodies and antigen-binding fragments thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1.

In certain embodiments, the inventive antibodies and antigen-binding fragments thereof display a cross-neutralization potency ($IC_{50}$) against human metapneumovirus (HMPV) as well as RSV. In certain such embodiments, the inventive antibodies and antigen-binding fragments thereof comprise at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to at least one of the CDRH1, a CDRH2, a CDRH3, a CDRL1, a CDRL2, and/or a CDRL3 amino acid sequences as disclosed in Table 6 of Antibody Number 340 as disclosed in Table 6.

In certain embodiments, the inventive antibodies and antigen-binding fragments thereof do not complete with D25, MPE8, palivizumab, motavizumab, or AM-14. In certain embodiments, the inventive antibodies and antigen-binding fragments thereof do not complete with D25, MPE8, palivizumab, or motavizumab. In certain embodiments, the inventive antibodies and antigen-binding fragments thereof do not complete with MPE8, palivizumab, or motavizumab. In certain embodiments, the inventive antibodies and antigen-binding fragments thereof do not complete with D25, palivizumab, or motavizumab. In certain embodiments, the inventive antibodies and antigen-binding fragments thereof do not complete with D25. In certain embodiments, the inventive antibodies and antigen-binding fragments thereof do not complete with MPE8. In certain embodiments, the inventive antibodies and antigen-binding fragments thereof do not complete with palivizumab. In certain embodiments, the inventive antibodies and antigen-binding fragments thereof do not complete with motavizumab.

In certain embodiments, the inventive antibodies and antigen-binding fragments thereof complete with one or more of D25, MPE8, palivizumab, motavizumab, and/or AM-14.

In certain embodiments, the inventive antibodies and antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

In certain embodiments, the inventive antibodies and antigen-binding fragments thereof comprise the CDRH3 amino acid sequence of any one of the antibodies designated Antibody Number 232 through Antibody Number 372 as disclosed in Table 6.

In certain embodiments, the inventive antibodies and antigen-binding fragments thereof comprise the CDRH2 amino acid sequence of any one of the antibodies designated Antibody Number 232 through Antibody Number 372 as disclosed in Table 6.

In certain embodiments, the inventive antibodies and antigen-binding fragments thereof comprise the CDRH1 amino acid sequence of any one of the antibodies designated Antibody Number 232 through Antibody Number 372 as disclosed in Table 6.

In certain embodiments, the inventive antibodies and antigen-binding fragments thereof comprise the CDRL3 amino acid sequence of any one of the antibodies designated Antibody Number 232 through Antibody Number 372 as disclosed in Table 6.

In certain embodiments, the inventive antibodies and antigen-binding fragments thereof comprise the CDRL2 amino acid sequence of any one of the antibodies designated Antibody Number 232 through Antibody Number 372 as disclosed in Table 6.

In certain embodiments, the inventive antibodies and antigen-binding fragments thereof comprise the CDRL1 amino acid sequence of any one of the antibodies designated Antibody Number 232 through Antibody Number 372 as disclosed in Table 6.

In certain embodiments, the inventive antibodies and antigen-binding fragments thereof comprise any combination of two, three, four, five, or six characteristics disclosed in the immediately preceeding six paragraphs.

In certain embodiments, the inventive antibodies and antigen-binding fragments thereof comprise a heavy chain (HC) amino acid sequence of any one of the antibodies designated Antibody Number 232 through Antibody Number 372 as disclosed in Table 6. In certain embodiments, the inventive antibodies and antigen-binding fragments thereof comprise a light chain (LC) amino acid sequence of any one of the antibodies designated Antibody Number 232 through Antibody Number 372 as disclosed in Table 6. In certain embodiments, the inventive antibodies and antigen-binding fragments thereof comprise a heavy chain (HC) amino acid sequence and a light chain (LC) amino acid sequence of any one of the antibodies designated Antibody Number 232 through Antibody Number 372 as disclosed in Table 6.

In certain embodiments, the inventive antibodies and antigen-binding fragments thereof are each selected from the group consisting antibodies that are at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to any one of the antibodies designated as Antibody Number 232 through Antibody Number 372 as disclosed in Table 6.

In certain embodiments, the inventive antibodies and antigen-binding fragments thereof comprise are each selected from the group consisting of the antibodies designated as Antibody Number 232 through Antibody Number 372 as disclosed in Table 6.

In certain embodiments, isolated nucleic acid sequences are provided that encode antibodies or antigen binding fragments thereof that specifically bind to Respiratory Syncytial Virus (RSV) F protein and antigen-binding fragments thereof, wherein at least one of the CDRH1, CDRH2, CDRH3, CDRL1, CDRL2, and/or CDRL3 amino acid sequences of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or at least 100% identical and/or all percentages of identity in between; to at least one the CDRH1, CDRH2, CDRH3, CDRL1, CDRL2, and/or CDRL3 amino acid sequences as disclosed in Table 6 of an antibody selected from Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH3 amino acid sequence of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH2 amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH1 amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL3 amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL2 amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL1 amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the heavy chain (HC) amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the heavy chain (LC) amino acid sequences of the antibodies designated Antibody Number 232 through Antibody Number 372 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences are each selected from the group consisting of sequences that are at least 70% identical; at least 75% identical; 80% identical; at least 85% identical; at least 90% identical; at least 95% identical; at least 96% identical; at least 97% identical; at least 98% identical; at least 99% identical; at least 100% identical, and/or all percentages of identity in between; to any one of the nucleic acid sequences that are disclosed in Table 6, and compliments thereof.

In certain embodiments, expression vectors are provided comprising the isolated nucleic acid sequences disclose herein and throughout, and in particular in the immediately preceding ten paragraphs.

In certain embodiments, host cells transfected, transformed, or transduced with the nucleic acid sequences and/or the expression vectors disclosed immediately above are provided.

Epitope Mapping and Related Technologies

As described above and as demonstrated in the EXAMPLES, Applicant has characterized the epitopic specificities, bin assignments, and antigenic site assignments of the inventive antibodies and antigen-binding fragments thereof. In addition to the methods for conducting such characterization, various other techniques are available to the artisan that can be used to carry out such characterization or to otherwise ascertain whether an antibody "interacts with one or more amino acids" within a polypeptide or protein. Exemplary techniques include, for example, a routine cross-blocking assay such as that described Antibodies, Harlow and Lane (Cold Spring Harbor Press, Cold Spring Harb., N.Y.) can be performed. Other methods include alanine scanning mutational analysis, peptide blot analysis (Reineke (2004) Methods Mol Biol 248:443-63), peptide cleavage analysis crystallographic studies and NMR analysis. In addition, methods such as epitope excision, epitope extraction and chemical modification of antigens can be employed (Tomer (2000) Protein Science 9: 487-496). Another method that can be used to identify the amino acids within a polypeptide with which an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antibody interface may retain deuterium and therefore exhibit relatively higher mass compared to amino acids not included in the interface. After dissociation of the antibody, the target protein is subjected to protease cleavage and mass spectrometry analysis, thereby revealing the deuterium-labeled residues that correspond to the specific amino acids with which the antibody interacts. See, e.g., Ehring (1999) Analytical Biochemistry 267 (2):252-259; Engen and Smith (2001) Anal. Chem. 73:256A-265A.

As the artisan will understand, an epitope can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5 or 8-10 amino acids in a unique spatial conformation.

Modification-Assisted Profiling (MAP), also known as Antigen Structure-based Antibody Profiling (ASAP) is a method that categorizes large numbers of monoclonal antibodies (mAbs) directed against the same antigen according to the similarities of the binding profile of each antibody to chemically or enzymatically modified antigen surfaces (U.S. Publ. No. 2004/0101920). Each category may reflect a unique epitope either distinctly different from or partially overlapping with epitope represented by another category. This technology allows rapid filtering of genetically identical antibodies, such that characterization can be focused on genetically distinct antibodies. When applied to hybridoma screening, MAP may facilitate identification of rare hybridoma clones that produce mAbs having the desired characteristics. MAP may be used to sort the antibodies of the invention into groups of antibodies binding different epitopes.

In certain embodiments, the inventive antibodies and/or antigen-binding fragments thereof interact with an amino acid sequence comprising the amino acid residues that are altered in one or more of the F protein patch variants disclosed, e.g., in the EXAMPLES and which are depicted in, e.g., FIG. 7A and which are designated as RSV F Variants 1, 2, 3, 4, 5, 6, 7, 8, 9, and DG. In certain embodiments, such inventive antibodies and antigen-binding fragments thereof interact with an amino acid sequence comprising the amino acid residues that are altered in RSV F Variant 2. In certain embodiments, the inventive antibodies and/or antigen-binding fragments thereof interact with amino acid residues that extend beyond the region(s) identified above by about 5 to 10 amino acid residues, or by about 10 to 15 amino acid residues, or by about 15 to 20 amino acid residues towards either the amino terminal or the carboxy terminal of the RSV-F protein.

In certain embodiments, the antibodies of the present invention do not bind to the same epitope on RSV-F protein as palivizumab, motavizumab, MPE8, or AM-14.

As the artisan understands, one can easily determine whether an antibody binds to the same epitope as, or competes for binding with, a reference anti-RSV-F antibody by using routine methods available in the art. For example, to determine if a test antibody binds to the same epitope as a reference RSV-F antibody of the invention, the reference antibody is allowed to bind to a RSV-F protein or peptide under saturating conditions. Next, the ability of a test antibody to bind to the RSV-F molecule is assessed. If the test antibody is able to bind to RSV-F following saturation binding with the reference anti-RSV-F antibody, it can be concluded that the test antibody binds to a different epitope than the reference anti-RSV-F antibody. On the other hand, if the test antibody is not able to bind to the RSV-F molecule following saturation binding with the reference anti-RSV-F antibody, then the test antibody may bind to the same epitope as the epitope bound by the reference anti-RSV-F antibody of the invention.

To determine if an antibody competes for binding with a reference anti-RSV-F antibody, the above-described binding methodology is performed in two orientations: In a first orientation, the reference antibody is allowed to bind to a RSV-F molecule under saturating conditions followed by assessment of binding of the test antibody to the RSV-F molecule. In a second orientation, the test antibody is allowed to bind to a RSV-F molecule under saturating conditions followed by assessment of binding of the reference antibody to the RSV-F molecule. If, in both orientations, only the first (saturating) antibody is capable of binding to the RSV-F molecule, then it is concluded that the test antibody and the reference antibody compete for binding to RSV-F. As will be appreciated by a person of ordinary skill in the art, an antibody that competes for binding with a reference antibody may not necessarily bind to the identical epitope as the reference antibody, but may sterically block binding of the reference antibody by binding an overlapping or adjacent epitope.

Two antibodies bind to the same or overlapping epitope if each competitively inhibits (blocks) binding of the other to the antigen. That is, a 1-, 5-, 10-, 20- or 100-fold excess of one antibody inhibits binding of the other by at least 50% but preferably 75%, 90% or even 99% as measured in a competitive binding assay (see, e.g., Junghans et al., Cancer Res. (1990) 50:1495-1502). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

Additional routine experimentation (e.g., peptide mutation and binding analyses) can then be carried out to confirm whether the observed lack of binding of the test antibody is in fact due to binding to the same epitope as the reference antibody or if steric blocking (or another phenomenon) is responsible for the lack of observed binding. Experiments of this sort can be performed using ELISA, RIA, surface plasmon resonance, flow cytometry or any other quantitative or qualitative antibody-binding assay available in the art.

Immunoconjugates

The invention encompasses a human RSV-F monoclonal antibody conjugated to a therapeutic moiety ("immunoconjugate"), such as an agent that is capable of reducing the severity of primary infection with RSV and/or HMPV, or to ameliorate at least one symptom associated with RSV infection and/or HMPV infection, including coughing, fever, pneumonia, or the severity thereof. Such an agent may be a second different antibody to RSV-F and/or HMPV, or a vaccine. The type of therapeutic moiety that may be conjugated to the anti-RSV-F antibody and/or anti-HMPV antibody and will take into account the condition to be treated and the desired therapeutic effect to be achieved. Alternatively, if the desired therapeutic effect is to treat the sequelae or symptoms associated with RSV and/or HMPV infection, or any other condition resulting from such infection, such as, but not limited to, pneumonia, it may be advantageous to conjugate an agent appropriate to treat the sequelae or symptoms of the condition, or to alleviate any side effects of the antibodies of the invention. Examples of suitable agents for forming immunoconjugates are known in the art, see for example, WO 05/103081.

Multi-Specific Antibodies

The antibodies of the present invention may be mono-specific, bi-specific, or multi-specific. Multi-specific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The antibodies of the present invention can be linked to or co-expressed with another functional molecule, e.g., another peptide or protein. For example, an antibody or fragment thereof can be functionally linked {e.g., by chemical coupling, genetic fusion, noncovalent association or otherwise) to one or more other molecular entities, such as another antibody or antibody fragment to produce a bi-specific or a multi-specific antibody with a second binding specificity.

An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). Further modifications that may be found within the second $C_{H3}$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies. Variations on the bi-specific antibody format described above are contemplated within the scope of the present invention.

Therapeutic Administration and Formulations

The invention provides therapeutic compositions (including pharmaceutical compositions) comprising the inventive anti-RSV-F and/or HMPV antibodies or antigen-binding fragments thereof. The administration of therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of each of the antibodies of the invention may vary depending upon the age and the size of a subject to be administered, target disease, conditions, route of administration, and the like. When the antibodies of the present invention are used for treating a RSV infection and/or HMPV infection in a patient, or for treating one or more symptoms associated with a RSV infection and/or HMPV infection, such as the cough or pneumonia associated with a RSV infection and/or HMPV in a patient, or for lessening the severity of the disease, it is advantageous to administer each of the antibodies of the present invention intravenously or subcutaneously normally at a single dose of about 0.01 to about 30 mg/kg body weight, more preferably about 0.1 to about 20 mg/kg body weight, or about 0.1 to about 15 mg/kg body weight, or about 0.02 to about 7 mg/kg body weight, about 0.03 to about 5 mg/kg body weight, or about 0.05 to about 3 mg/kg body weight, or about 1 mg/kg body weight, or about 3.0 mg/kg body weight, or about 10 mg/kg body weight, or about 20 mg/kg body weight. Multiple doses may be administered as necessary. Depending on the severity of the condition, the frequency and the duration of the treatment can be adjusted. In certain embodiments, the antibodies or antigen-binding fragments thereof of the invention can be administered as an initial dose of at least about 0.1 mg to about 800 mg, about 1 mg to about 600 mg, about 5 mg to about 300 mg, or about 10 mg to about 150 mg, to about 100 mg, or to about 50 mg. In certain embodiments, the initial dose may be followed by administration of a second or a plurality of subsequent doses of the antibodies or antigen-binding fragments thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural and oral routes. The composition may be administered by any convenient route, for example by infusion or bolus injection, by absorption through epithelial or mucocutaneous linings {e.g., oral mucosa, nasal mucosa, rectal and intestinal mucosa, etc.) and may be administered together with other biologically active agents. Administration can be systemic or local. It may be delivered as an aerosolized formulation (See U.S. Publ. No. 2011/0311515 and U.S. Publ. No. 2012/0128669). The delivery of agents useful for treating respiratory diseases by inhalation is becoming more widely accepted (See A. J. Bitonti and J. A. Dumont, (2006), Adv. Drug Deliv. Rev, 58:1 106-1118). In addition to being effective at treating local pulmonary disease, such a delivery mechanism may also be useful for systemic delivery of antibodies (See Maillet et al. (2008), Pharmaceutical Research, Vol. 25, No. 6, 2008).

The pharmaceutical composition can be also delivered in a vesicle, in particular a liposome (see, for example, Langer (1990) Science 249:1527-1533).

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™ OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L.P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Administration Regimens

According to certain embodiments, multiple doses of an antibody to RSV-F and/or HMPV, or a pharmaceutical composition comprising or encoding for these antibodies, may be administered to a subject over a defined time course. The methods according to this aspect of the invention comprise sequentially administering to a subject multiple doses of an antibody to RSV-F and/or HMPV, or sequentially administering to a subject multiple doses of a pharmaceutical composition comprising or encoding for an antibody of the invention or antigen binding fragment thereof. As used herein, "sequentially administering" means that each dose of antibody to RSV-F and/or HMPV, or the pharmaceutical composition, is administered to the subject at a different point in time, e.g., on different days separated by a predetermined interval (e.g., hours, days, weeks or months). The present invention includes methods which comprise sequentially administering to the patient a single initial dose of an antibody to RSV-F and/or HMPV, or a composition comprising or encoding for the antibodies, followed by one or more secondary doses of the antibody to RSV-F and/or HMPV, or the composition, and optionally followed by one or more tertiary doses of the antibody to RSV-F and/or HMPV, or the composition.

The terms "initial dose," "secondary doses," and "tertiary doses," refer to the temporal sequence of administration of the antibody to RSV-F and/or HMPV or the compositions of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of antibody to RSV-F and/or HMPV, but generally may differ from one another in terms of frequency of administration. In certain embodiments, however, the amount of antibody to RSV-F and/or HMPV contained in the initial, secondary and/or tertiary doses vary from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antibody to RSV-F and/or HMPV which is administered to a patient prior to the administration of the very next dose in the sequence with no intervening doses.

The methods according to this aspect of the invention may comprise administering to a patient any number of secondary and/or tertiary doses of an antibody to RSV-F and/or HMPV. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Accordingly, in certain embodiments are provided pharmaceutical compositions comprising: one or more of the inventive antibodies or antigen-binding fragments thereof disclosed herein and throughout and a pharmaceutically acceptable carrier and/or one or more excipients. In certain other embodiments are provided pharmaceutical compositions comprising: one or more nucleic acid sequences encoding one or more inventive antibodies or antigen-binding fragments thereof; or one or more the expression vectors harbouring such nucleic acid sequences; and a pharmaceutically acceptable carrier and/or one or more excipients.

Therapeutic Uses of the Antibodies and Pharmaceutical Compositions

Due to their binding to and interaction with the RSV fusion protein (RSV-F), it is believed that the inventive antibodies and antigen-binding fragments thereof are useful—without wishing to be bound to any theory—for preventing fusion of the virus with the host cell membrane, for preventing cell to cell virus spread, and for inhibition of syncytia formation. Additionally, as Applicant has demonstrated herein that, surprisingly, a subset of the inventive anti-RSV antibodies and antigen-binding fragment thereof display crass-neutralizing potency against HMPV, the inventive antibodies and antigen-binding fragments thereof are advantageous for preventing an infection of a subject with RSV and/or HMPV when administered prophylactically. Alternatively, the antibodies of the present invention may be useful for ameliorating at least one symptom associated with the infection, such as coughing, fever, pneumonia, or for lessening the severity, duration, and/or frequency of the infection. The antibodies of the invention are also contemplated for prophylactic use in patients at risk for developing or acquiring an RSV infection and/or HMPV infection. These patients include preterm infants, full term infants born during RSV season (late fall to early spring), the elderly (for example, in anyone 65 years of age or older) and/or HMPV season, or patients immunocompromised due to illness or treatment with immunosuppressive therapeutics, or patients who may have an underlying medical condition that predisposes them to an RSV infection (for example, cystic fibrosis patients, patients with congestive heart failure or other cardiac conditions, patients with airway impairment, patients with COPD) and/or HMPV infection. It is contemplated that the antibodies of the invention may be used alone, or in conjunction with a second agent, or third agent for treating RSV infection and/or HMPV infection, or for alleviating at least one symptom or complication associated with the RSV infection and/or HMPV infection, such as the fever, coughing, bronchiolitis, or pneumonia associated with, or resulting from such an infection. The second or third agents may be delivered concurrently with the antibodies of the invention, or they may be administered separately, either before or after the antibodies of the invention. The second or third agent may be an anti-viral such as ribavirin, an NSAID or other agents to reduce fever or pain, another second but different antibody that specifically binds RSV-F, an agent (e.g. an antibody) that binds to another RSV antigen, such as RSV-G, a vaccine against RSV, an siRNA specific for an RSV antigen.

In yet a further embodiment of the invention the present antibodies are used for the preparation of a pharmaceutical composition for treating patients suffering from a RSV infection and/or HMPV infection. In yet another embodiment of the invention the present antibodies are used for the preparation of a pharmaceutical composition for reducing the severity of a primary infection with RSV and/or HMPV, or for reducing the duration of the infection, or for reducing at least one symptom associated with the RSV infection and/or the HMPV infection. In a further embodiment of the invention the present antibodies are used as adjunct therapy with any other agent useful for treating an RSV infection and/or and HMPV infection, including an antiviral, a toxoid, a vaccine, a second RSV-F antibody, or any other antibody specific for an RSV antigen, including an RSV-G antibody, or any other palliative therapy known to those skilled in the art.

Accordingly, in certain embodiments are provided methods of treating or preventing a Respiratory Syncytial Virus (RSV) infection, or at least one symptom associated with RSV infection, comprising administering to a patient in need thereof or suspected of being in need thereof one or more of the inventive antibodies or antigen-binding fragments thereof disclosed herein and throughout (or pharmaceutical composition of the invention), such as, e.g., one or more of the anti-RSV antibodies disclosed in Table 6, such that the RSV infection is treated or prevented, or the at least on symptom associated with RSV infection is treated, alleviated, or reduced in severity.

In certain other embodiments are provided methods of treating or preventing a Respiratory Syncytial Virus (RSV) infection, or at least one symptom associated with RSV infection, comprising administering to a patient in need thereof or suspected of being in need thereof a nucleic acid sequence encoding one or more of the inventive antibodies or antigen-binding fragments thereof, such nucleic acid sequenced disclosed in Table 6 and compliments thereof, such that the RSV infection is treated or prevented, or the at least on symptom associated with RSV infection is treated, alleviated, or reduced in severity.

In additional embodiments are provided methods of treating or preventing a Respiratory Syncytial Virus (RSV) infection, are at least one symptom associated with RSV infection, comprising administering to a patient in need thereof or suspected of being in need thereof a host cell harboring a nucleic acid sequence or an expression vector comprising such a nucleic aci sequence, wherein such nucleic acid sequences is selected from the group consisting of sequences disclosed in Table 6 and compliments thereof, such that the RSV infection is treated or prevented, or the at least on symptom associated with RSV infection is treated, alleviated, or reduced in severity.

In additional embodiments are provided methods of treating or preventing a Respiratory Syncytial Virus (RSV) infection, are at least one symptom associated with RSV infection, comprising administering to a patient in need thereof or suspected of being in need thereof a pharmaceutical composition comprising either: one or more of the inventive antibodies or antigen-binding fragments thereof as disclosed in Table 6; one or more nucleic acid sequences or an expression vectors comprising such a nucleic acid sequence, wherein such nucleic acid sequences are selected from the group consisting of sequences disclosed in Table 6 and compliments thereof; one or more host cells harboring one or more nucleic acid sequences or an expression vectors comprising such one or more nucleic acid sequences, wherein such nucleic acid sequences are selected from the group consisting of sequences disclosed in Table 6 and compliments thereof; and a pharmaceutically acceptable carrier and/or one or more excipients, such that the RSV infection is treated or prevented, or the at least on symptom associated with RSV infection is treated, alleviated, or reduced in severity.

In certain embodiments are provided methods of treating or preventing either a Respiratory Syncytial Virus (RSV) infection or a human metapneumovirus (HMPV) infection, are at least one symptom associated with said RSV infection or said HMPV infection, comprising administering to a patient in need thereof or suspected of being in need thereof one or more of the inventive antibodies or antigen-binding fragments thereof disclosed herein and throughout, such as, e.g., one or more of the anti-RSV antibodies disclosed in Table 6, such that the RSV infection is treated or prevented, or the at least on symptom associated with RSV infection is treated, alleviated, or reduced in severity. In certain embodiments, the one or more antibodies or antigen-binding fragments thereof comprises Antibody Number 340 as disclosed in Table 6.

In certain other embodiments are provided methods of treating or preventing either a Respiratory Syncytial Virus (RSV) infection or a human metapneumovirus (HMPV) infection, are at least one symptom associated with said RSV infection or said HMPV infection, comprising administering to a patient in need thereof or suspected of being in need thereof a nucleic acid sequence encoding one or more of the inventive antibodies or antigen-binding fragments thereof, such nucleic acid sequenced disclosed in Table 6 and compliments thereof, such that the RSV infection is treated or prevented, or the at least on symptom associated with RSV infection is treated, alleviated, or reduced in severity. In certain embodiments, the one or more antibodies or antigen-binding fragments thereof comprises Antibody Number 340 as disclosed in Table 6.

In additional embodiments are provided methods of treating or preventing either a Respiratory Syncytial Virus (RSV) infection or a human metapneumovirus (HMPV) infection, are at least one symptom associated with said RSV infection or said HMPV infection, comprising administering to a patient in need thereof or suspected of being in need thereof a host cell harboring a nucleic acid sequence or an expression vector comprising such a nucleic acid sequence, wherein such nucleic acid sequences is selected from the group consisting of sequences disclosed in Table 6 and compliments thereof, such that the RSV infection is treated or prevented, or the at least on symptom associated with RSV infection is treated, alleviated, or reduced in severity. In certain embodiments, the one or more antibodies or antigen-binding fragments thereof comprises Antibody Number 340 as disclosed in Table 6.

In additional embodiments are provided methods of treating or preventing either a Respiratory Syncytial Virus (RSV) infection or a human metapneumovirus (HMPV) infection, are at least one symptom associated with said RSV infection or said HMPV infection, comprising administering to a patient in need thereof or suspected of being in need thereof a pharmaceutical composition comprising either: one or more of the inventive antibodies or antigen-binding fragments thereof as disclosed in Table 6; one or more nucleic acid sequences or an expression vectors comprising such a nucleic acid sequence, wherein such nucleic acid sequences are selected from the group consisting of sequences disclosed in Table 6 and compliments thereof; one or more host cells harboring one or more nucleic acid sequences or an expression vectors comprising such one or more nucleic acid sequences, wherein such nucleic acid sequences are selected from the group consisting of sequences disclosed in Table 6 and compliments thereof; and a pharmaceutically acceptable carrier and/or one or more excipients, such that the RSV infection is treated or prevented, or the at least on symptom associated with RSV infection is treated, alleviated, or reduced in severity. In certain embodiments, the one or more antibodies or antigen-binding fragments thereof comprises Antibody Number 340 as disclosed in Table 6.

Combination Therapies

As noted above, according to certain embodiments, the disclosed methods comprise administering to the subject one or more additional therapeutic agents in combination with an antibody to RSV-F and or HMPV. As used herein, the expression "in combination with" means that the additional therapeutic agents are administered before, after, or concurrent with the pharmaceutical composition comprising the anti-RSV-F antibody. The term "in combination with" also includes sequential or concomitant administration of the anti-RSV-F antibody and a second therapeutic agent.

For example, when administered "before" the pharmaceutical composition comprising the anti-RSV-F antibody, the additional therapeutic agent may be administered about 72 hours, about 60 hours, about 48 hours, about 36 hours, about 24 hours, about 12 hours, about 10 hours, about 8 hours, about 6 hours, about 4 hours, about 2 hours, about 1 hour, about 30 minutes, about 15 minutes or about 10 minutes prior to the administration of the pharmaceutical composition comprising the anti-RSV-F antibody. When administered "after" the pharmaceutical composition comprising the anti-RSV-F antibody, the additional therapeutic agent may be administered about 10 minutes, about 15 minutes, about 30 minutes, about 1 hour, about 2 hours, about 4 hours, about 6 hours, about 8 hours, about 10 hours, about 12 hours, about 24 hours, about 36 hours, about 48 hours, about 60 hours or about 72 hours after the administration of the pharmaceutical composition comprising the anti-RSV-F antibodies. Administration "concurrent" or with the pharmaceutical composition comprising the anti-RSV-F antibody means that the additional therapeutic agent is administered to the subject in a separate dosage form within less than 5 minutes (before, after, or at the same time) of administration of the pharmaceutical composition comprising the anti-RSV-F antibody, or administered to the subject as a single combined dosage formulation comprising both the additional therapeutic agent and the anti-RSV-F antibody.

Combination therapies may include an anti-RSV-F antibody of the invention and any additional therapeutic agent that may be advantageously combined with an antibody of the invention, or with a biologically active fragment of an antibody of the invention.

For example, a second or third therapeutic agent may be employed to aid in reducing the viral load in the lungs, such as an antiviral, for example, ribavirin. The antibodies may also be used in conjunction with other therapies, as noted above, including a toxoid, a vaccine specific for RSV, a second antibody specific for RSV-F, or an antibody specific for another RSV antigen, such as RSV-G.

Diagnostic Uses of the Antibodies

The inventive anti-RSV antibodies and antigen-binding fragments thereof may also be used to detect and/or measure RSV and/or HMPV in a sample, e.g., for diagnostic purposes. It is envisioned that confirmation of an infection thought to be caused by RSV and/or HMPV may be made by measuring the presence of the virus through use of any one or more of the antibodies of the invention. Exemplary diagnostic assays for RSV and/or HMPV may comprise, e.g., contacting a sample, obtained from a patient, with an anti-RSV-F and/or HMPV antibody of the invention, wherein the anti-RSV-F and/or HMPV antibody is labeled with a detectable label or reporter molecule or used as a capture ligand to selectively isolate the virus containing the F protein from patient samples. Alternatively, an unlabeled anti-RSV-F and/or HMPV antibody can be used in diagnostic applications in combination with a secondary antibody which is itself detectably labeled. The detectable label or reporter molecule can be a radioisotope, such as $^3$H, $^{14}$C, $^{32}$P, $^{35}$S, or $^{125}$I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure RSV containing the F protein and/or HMPV in a sample include enzyme-linked immunosorbent assay (ELISA), radioimmunoassay (RIA), and fluorescence-activated cell sorting (FACS).

Samples that can be used in RSV and/or HMPV diagnostic assays according to the present invention include any tissue or fluid sample obtainable from a patient, which contains detectable quantities of RSV-F protein and/or HMPV, or fragments thereof, under normal or pathological conditions. Generally, levels of RSV-F and/or HMPV in a particular sample obtained from a healthy patient (e.g., a patient not afflicted with a disease or condition associated with the presence of RSV-F and/or HMPV) will be measured to initially establish a baseline, or standard, level of the F protein from RSV and/or HMPV. This baseline level of RSV-F and/or HMPV can then be compared against the levels of RSV-F and/or HMPV measured in samples obtained from individuals suspected of having an RSV and/or HMPV infection, or symptoms associated with such infection.

EXAMPLES

Applicant has comprehensively profiled the human antibody response to RSV fusion protein (F) by isolating and characterizing 133 RSV F-specific monoclonal antibodies from the memory B cells of a healthy adult donor, and used these antibodies to comprehensively map the antigenic topology of RSV F. The antibody response to RSV F was determined to be comprised of a broad diversity of clones that target several antigenic sites. Nearly half of the most potent antibodies target a previously undefined site of vulnerability near the apex of the prefusion conformation of RSV F (preF), providing strong support for the development of RSV antibodies that target this region, as well as vaccine candidates that preserve the membrane-distal hemisphere of the preF protein. Additionally, this class of antibodies displayed convergent sequence features, thus providing a future means to rapidly detect these types of antibodies in human samples. Many of the antibodies that bound preF-specific surfaces from this donor were over 100 times more potent than palivizumab, and one antibody cross-neutralized human metapneumovirus (HMPV). Taken together, the results have implications for the design and evaluation of RSV vaccine and antibody-based therapeutic candidates, and offer new options for passive prophylaxis.

Large-Scale Isolation of RSV F-Specific Monoclonal Antibodies from Healthy Adult Human Donors In order to comprehensively profile the human antibody response to RSV F, Applicant isolated and characterized 133 monoclonal antibodies from the memory B cells of a healthy adult donor ("donor 006"). Although this donor did not have a documented history of RSV infection, healthy adults are expected to have had multiple RSV infections throughout life (26).

Figure 1B:
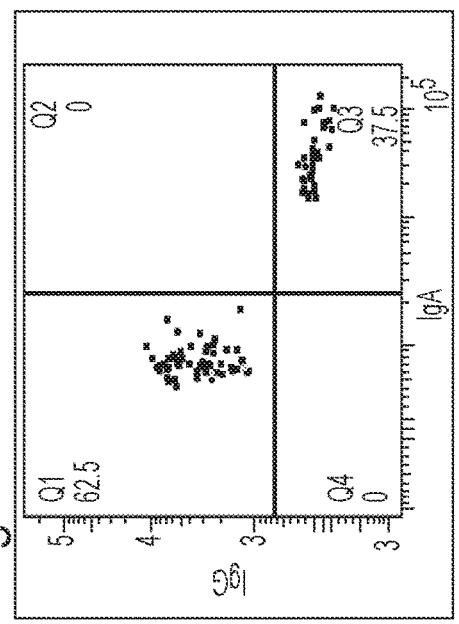
Figure 6B:
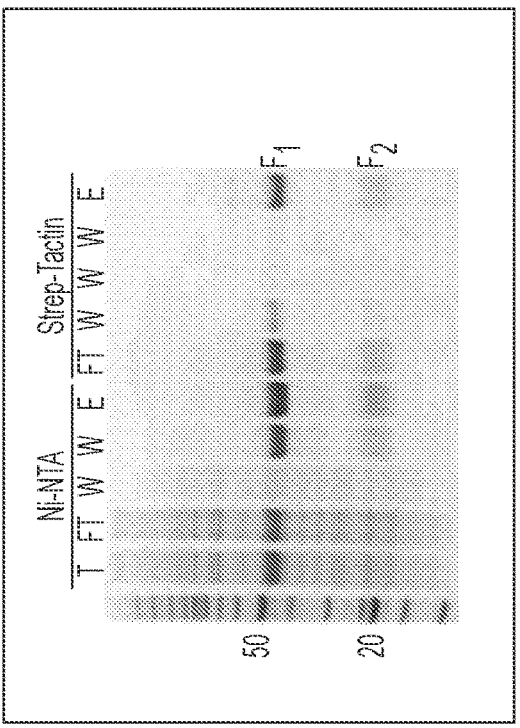
Figure 6C:
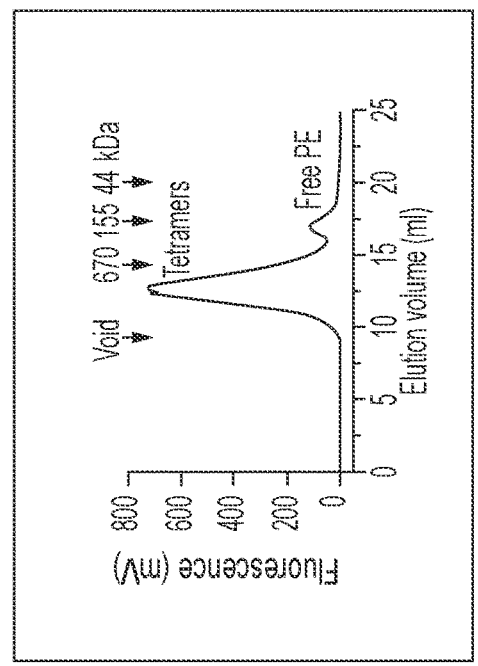
Figure 6A:
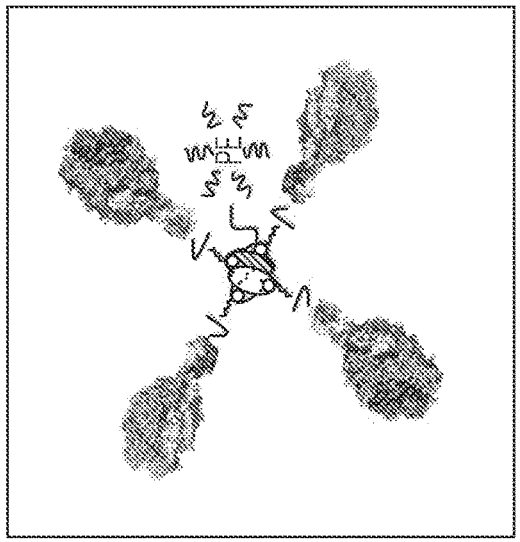

The magnitude of the memory B cell response in this donor to RSV F was assessed by staining peripheral B cells with a mixture of fluorescently labeled pre- and postfusion RSV F sorting probes (FIG. 6A through 6B) (11, 15). Both proteins were dual-labeled in order to eliminate background due to non-specific fluorochrome binding (27). Flow cytometric analysis revealed that 0.04-0.18% of class-switched (IgG$^+$ and IgA$^+$) peripheral B cells were specific for RSV F (FIG. 1A and FIG. B), which is significantly lower than the percentage of RSV F-specific cells observed after experimental RSV infection and suggests that this donor was probably not recently exposed to RSV (28). Notably, index sorting showed that 17-38% of circulating RSV F-specific B cells express IgA, indicating that IgA memory B cells to RSV F are present in peripheral blood (FIG. 1B).

Approximately 200 RSV F-specific B cells were single-cell sorted from the donor sample, and antibody variable heavy (VH) and variable light (VL) chain genes were rescued by single-cell PCR (29). One hundred thirty-three (133) cognate heavy and light chain pairs were subsequently cloned and expressed as full-length IgGs in an engineered strain of *Saccharomyces cerevisiae* for further characterization (30). Preliminary binding studies showed that approximately 80% of antibodies cloned from RSV F glycoprotein (F)-specific B cells bound to recombinant RSV F proteins.

Sequence Analysis of RSV F-Specific Antibody Repertoires

Sequence analysis of the isolated monoclonal antibodies revealed that the RSV-F specific repertoire was highly diverse, containing over 70 unique lineages (FIG. 1C and Table 2). This result is in stark contrast to the relatively restricted repertoires observed in HIV-infected patients (31), or in healthy donors after influenza vaccination (32). Compared to non-RSV-reactive antibodies (33), the RSV F-specific repertoires were skewed, generally, toward certain VH germline genes (VH1-18, VH1-2, VH1-69, VH2-70, VH4-304, and VH5-51) (FIG. 1D and Table 2) and longer heavy chain third complementarity-determining region (CDRH3) lengths (generally, approximately 14-18 amino acids in length; FIG. 1E and Table 2). Interestingly, a bias toward VH1-69 has also been observed in anti-HIV-1, anti-influenza, and anti-HCV repertoires (34-36), and recent studies have shown that there is a significant increase in the relative usage of VH1-18, VH1-2, and VH1-69 during acute dengue infection (37). Hence, it appears that these particular germline gene segments may have inherent properties that facilitate recognition of viral envelope proteins.

The average level of somatic hypermutation (SHM) ranged generally between 16 and 30 nucleotide substitutions per VH gene (excluding CDRH3) (FIG. 1F and Table 2), which is comparable to the average level of SHM observed in anti-influenza antibody repertoires (32, 38) and consistent with the recurrent nature of RSV infection (26). Interestingly, several antibodies contained 40 or greater VH gene nucleotide substitutions, suggesting that multiple rounds of RSV infection can result in antibodies with very high levels of somatic hypermutation (SHM).

A Large Proportion of Antibodies Bind Exclusively to PreF

Figure 2A:
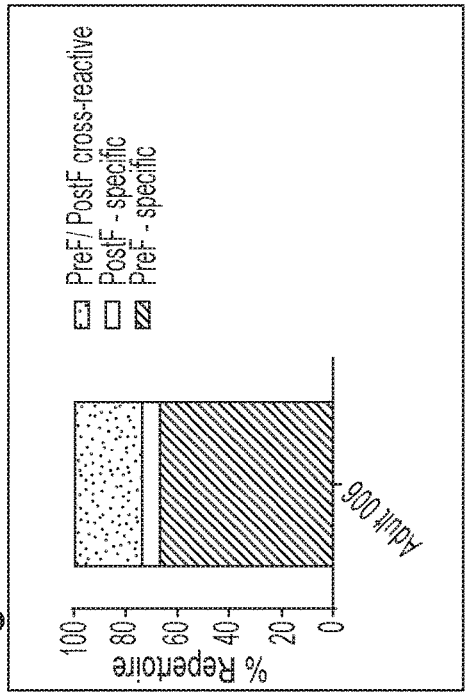
FIGS. 2A-2D illustrate the similar antibody preferences observed for conformational state and subtype of RSV F in the repertoire.

We next measured the apparent binding affinities of the IgGs to furin-cleaved RSV F ectodomains stabilized in the prefusion (DS-Cav1) or postfusion (F ΔFP) conformation using biolayer interferometry (11, 15). A relatively large proportion of the antibodies (36-67%) bound exclusively to preF (FIG. 2A and FIG. B; Table 3). The vast majority of remaining antibodies bound to both pre- and postF, with only 5-7% of antibodies showing exclusive postF specificity (FIG. 2A and FIG. B; Table 3). The low prevalence of postF-specific antibodies in these donor repertoires is consistent with the observation that less than 10% of anti-RSV F serum-binding activity specifically targets postF (8). Interestingly, however, the majority of cross-reactive antibodies bound with higher apparent affinity to postF (FIG. 2A; Table 3), suggesting that these antibodies were probably elicited by and/or affinity matured against postF in vivo. Hence, the significantly higher proportion of preF- versus postF-specific antibodies is likely due to the higher immunogenicity of the unique surfaces on preF compared to postF, rather than an increased abundance of preF in vivo. Finally, as expected based on the relatively high degree of sequence conservation between RSV subtypes, most of the antibodies showed binding reactivity to F proteins derived from both subtypes A and B (FIG. 2C; Table 3).

Since certain antiviral antibody specificities have been associated with poly- and autoreactivity (39-41), we also tested the RSV antibodies for polyreactivity using a previously described high-throughput assay that correlates with down-stream behaviors such as serum clearance (42, 43). One hundred and seventy-seven clinical antibodies, as well as several broadly neutralizing HIV antibodies, were also included for comparison. Interestingly, in contrast to many previously described HIV broadly neutralizing antibodies, the vast majority of RSV F-specific antibodies lacked significant polyreactivity in this assay (FIG. 2D).

RSV F-Specific Antibodies Target Six Major Antigenic Sites

To map the antigenic specificities of the RSV F-specific antibodies, Applicant first performed competitive binding experiments using a previously described yeast-based assay (44). Antibodies were initially tested for competition with D25, AM14 and MPE8—three previously described preF-specific antibodies (10, 17, 21)—and motavizumab, an affinity-matured variant of palivizumab that binds to both pre- and postF (10, 11, 45). Non-competing antibodies were then tested for competition with a site IV-directed mAb (101F) (46), a site I-directed antibody (Site I Ab), and two high affinity antibodies (High Affinity Ab I and High Affinity Ab 2, respectively) that did not strongly compete with each other or any of the control antibodies. Each antibody was assigned a bin based on the results of this competition assay (see, e.g., Table 4).

In order to confirm and increase the resolution of our epitope assignments, the binding of each antibody to a panel of preF variants was measured using a luminex-based assay. Each variant contained 2-4 mutations clustered together to form a patch on the surface of preF. A total of nine patches that uniformly covered the surface of preF were generated (FIG. 7A through FIG. 7C). Deglycosylated preF was also included to identify antibodies targeting glycan-dependent epitopes. Binding of each antibody to the 10 preF variants was compared to that of wild-type preF and used to assign a patch (see, e.g., Table 4). Previously characterized antibodies D25, AM14 and motavizumab were used to validate the assay (se, e.g., FIG. 7C and Table 4). The combined bin and patch data were then used to assign each antibody to a single antigenic site (FIG. 3A through FIG. 3G), which were defined based on previously determined structures, resistance mutations, and secondary structure elements of the F protein. Overall, these data show that the large majority of isolated antibodies target six dominant antigenic sites on prefusion RSV F (Ø, I, II, III, IV, and V). Interestingly, only a small proportion of the isolated antibodies had binding profiles similar to that of AM14, suggesting that antibodies targeting this quaternary epitope are not commonly elicited during natural infection. None of the antibodies were sensitive to deglycosylation of F, demonstrating that glycan-dependent antibodies are also rarely elicited by natural RSV infection.

Figure 8:
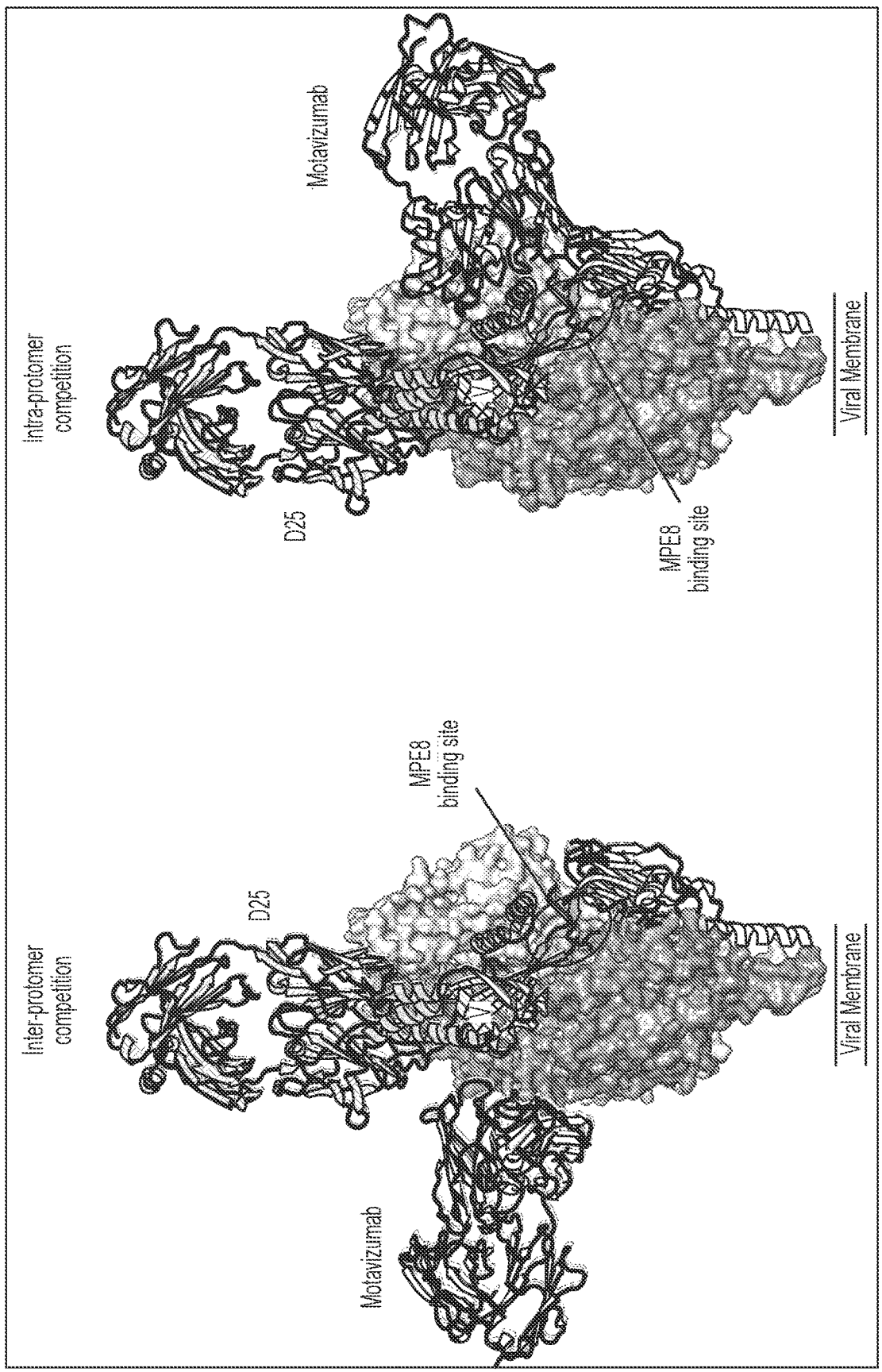

Analysis of the preF- and postF-binding activities of the antibodies targeting each antigenic site (see, e.g., FIG. 3C through FIG. 3G; Table 4) revealed that three sites are primarily found on preF (Ø, III, and V). Antibodies targeting site Ø and site III have been previously described (10, 17), and these sites are located on the top and side of the preF spike, respectively. Approximately 18% of the antibodies from this donor recognized site Ø and approximately 20% recognized site III. A relatively large proportion of antibodies from this donor (approximately 26%) recognized the third preF-specific site, which has not been previously described and therefore has been designated herein as region site V (See, e.g., FIG. 3C through FIG. 3G; Table 4). The majority of site V antibodies competed with D25, MPE8 and motavizumab, which was unexpected given the distance between the epitopes recognized by these three antibodies. The patch mutant analysis revealed that these antibodies interact with the α3 helix and β3/β4 hairpin of preF. This region is located between the epitopes recognized by D25, MPE8, and motavizumab, explaining the unusual competition profile observed for this class of antibodies (See, e.g., FIG. 8). In addition to the three primarily preF-specific sites, a large number of the antibodies that recognized antigenic site IV were preF-specific, likely due to contacts with β22, which dramatically rearranges during the transition from pre- to postF. In summary, the epitope mapping data show that the large majority of isolated antibodies target six dominant antigenic sites, approximately half of which are exclusively expressed on preF.

Highly Potent Neutralizing Antibodies Target PreF-Specific Epitopes

The antibodies were next tested for neutralizing activity against RSV subtypes A and B using a previously described high-throughput neutralization assay (15). Greater than 70% of the isolated antibodies showed neutralizing activity, and approximately 35%-40% neutralized with high potency ($IC_{50} \leq 0.05$ μg/ml) (see, e.g., FIG. 4A and FIG. 4B; Table 3).

Figure 4A:
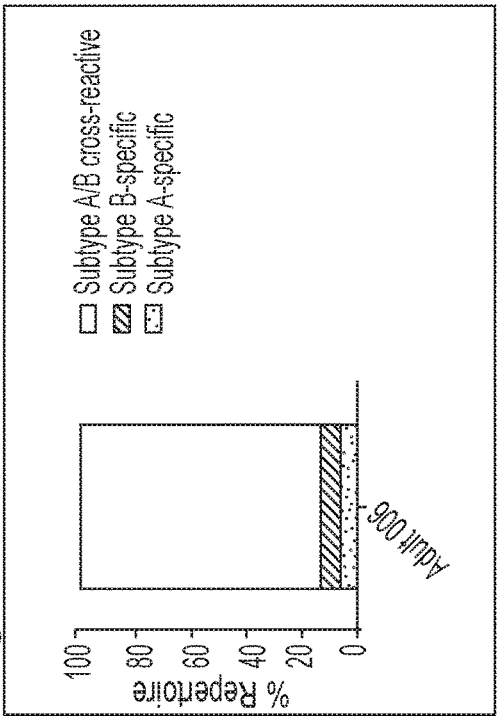
FIGS. 4A-4G illustrate neutralizing potencies of anti-RSV antibodies and correlation between potency and Pref vs. PostF specificity for each of RSV subtypes A and B.
Figure 4C:
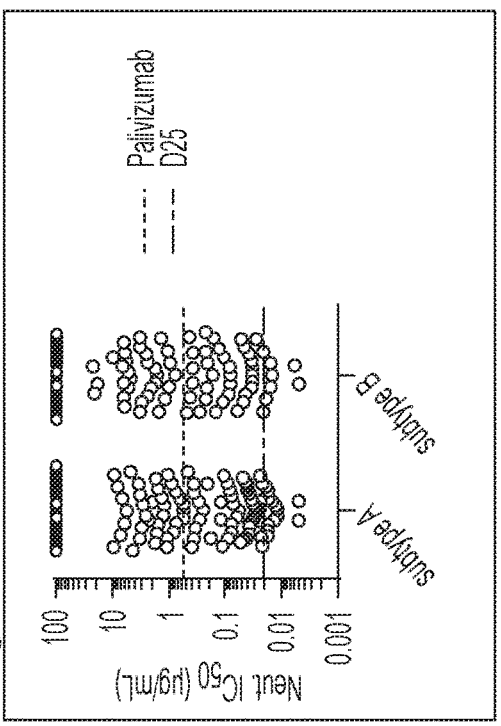
Figure 4B:
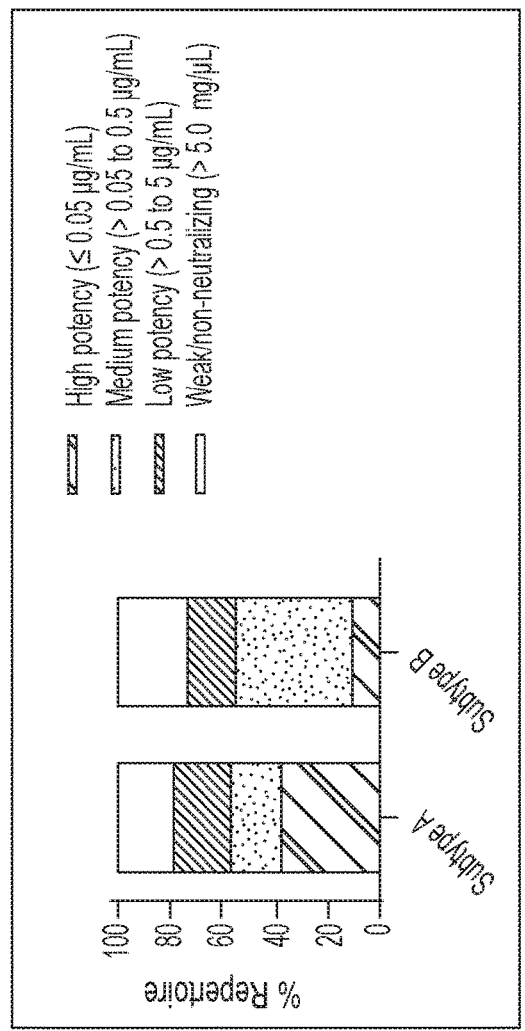
Figure 4D:
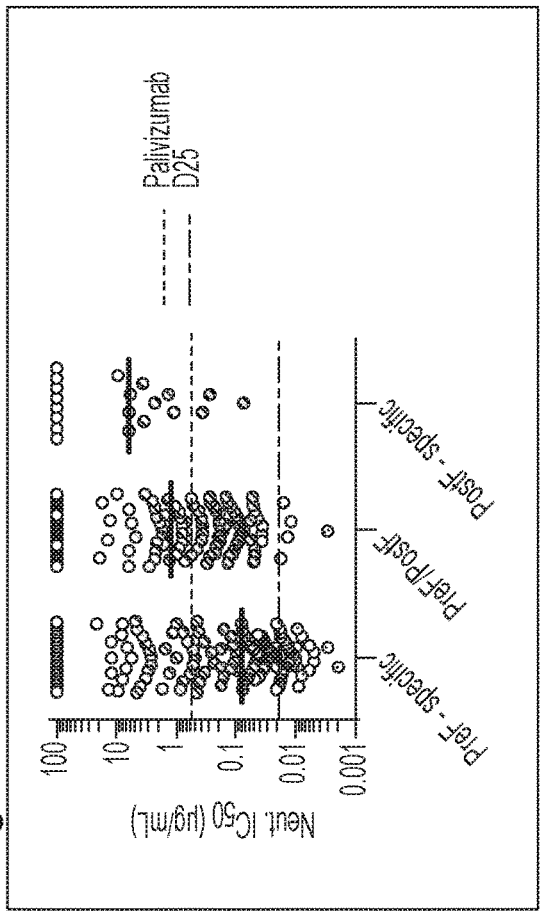
Figure 4E:
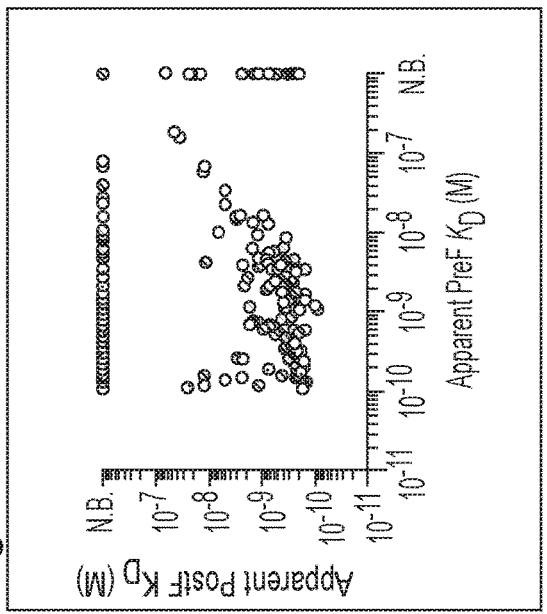
Figure 4F:
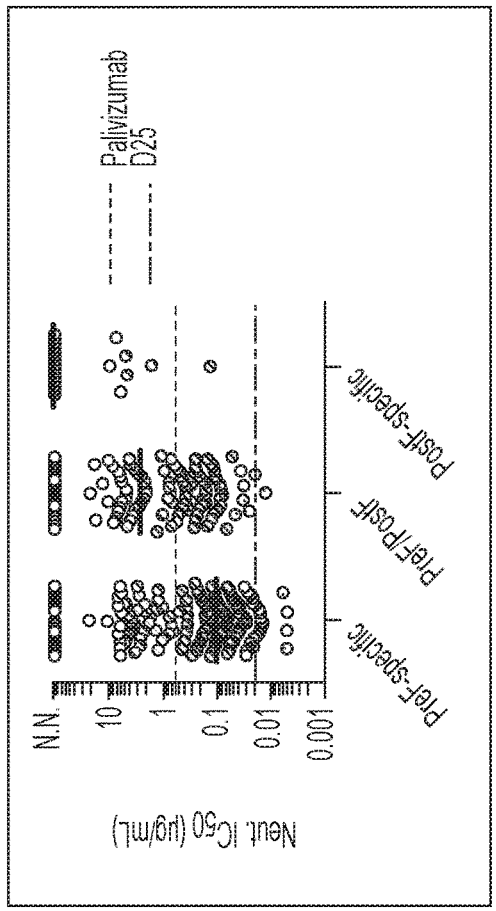
Figure 4G:
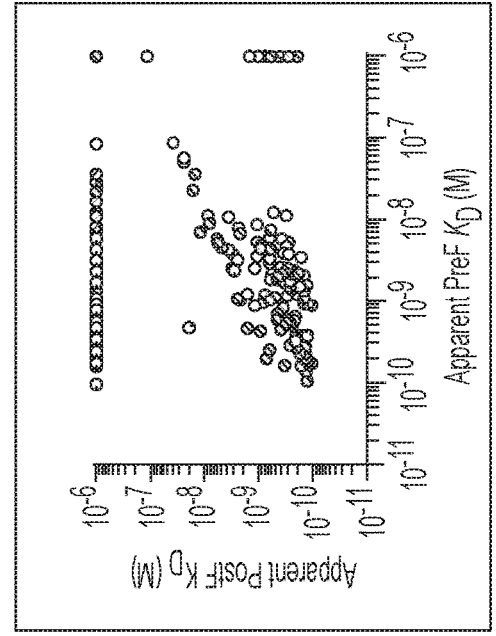

Notably, several clonally unrelated antibodies were ≥5.0-fold more potent than D25 and ≥100-fold more potent than palivizumab (see, e.g., FIG. 4A; Table 3). Interestingly, there was no correlation between neutralization potency and level of SHM, suggesting that extensive SHM is not required for potent neutralization of RSV. Consistent with the binding cross-reactivity data, the majority of neutralizing antibodies showed activity against both subtype A and B (FIG. 4A through FIG. 4C; Table 3).

Figure 5B:
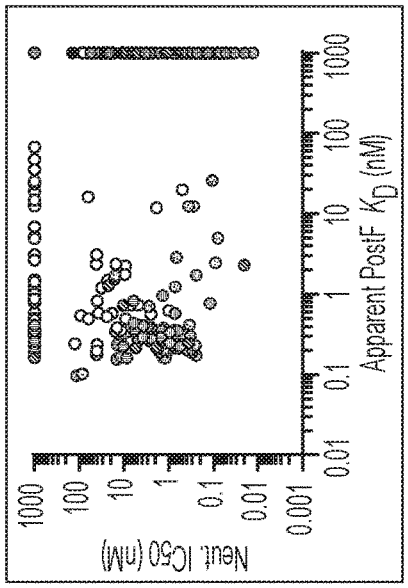
FIGS. 5A-5C illustrate that the most potent neutralizing antibodies bind with high affinity to preF and recognize antigenic sites Ø and V.
Figure 5A:
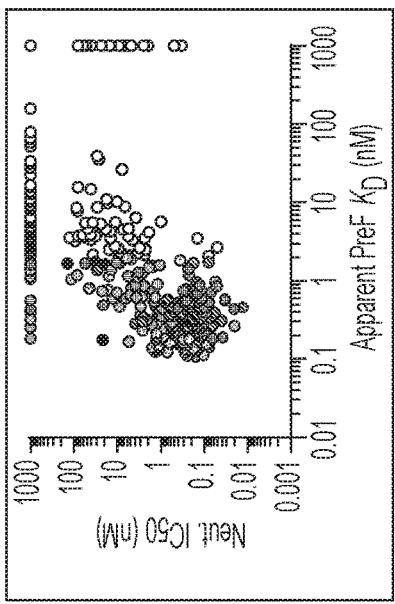
Figure 9:
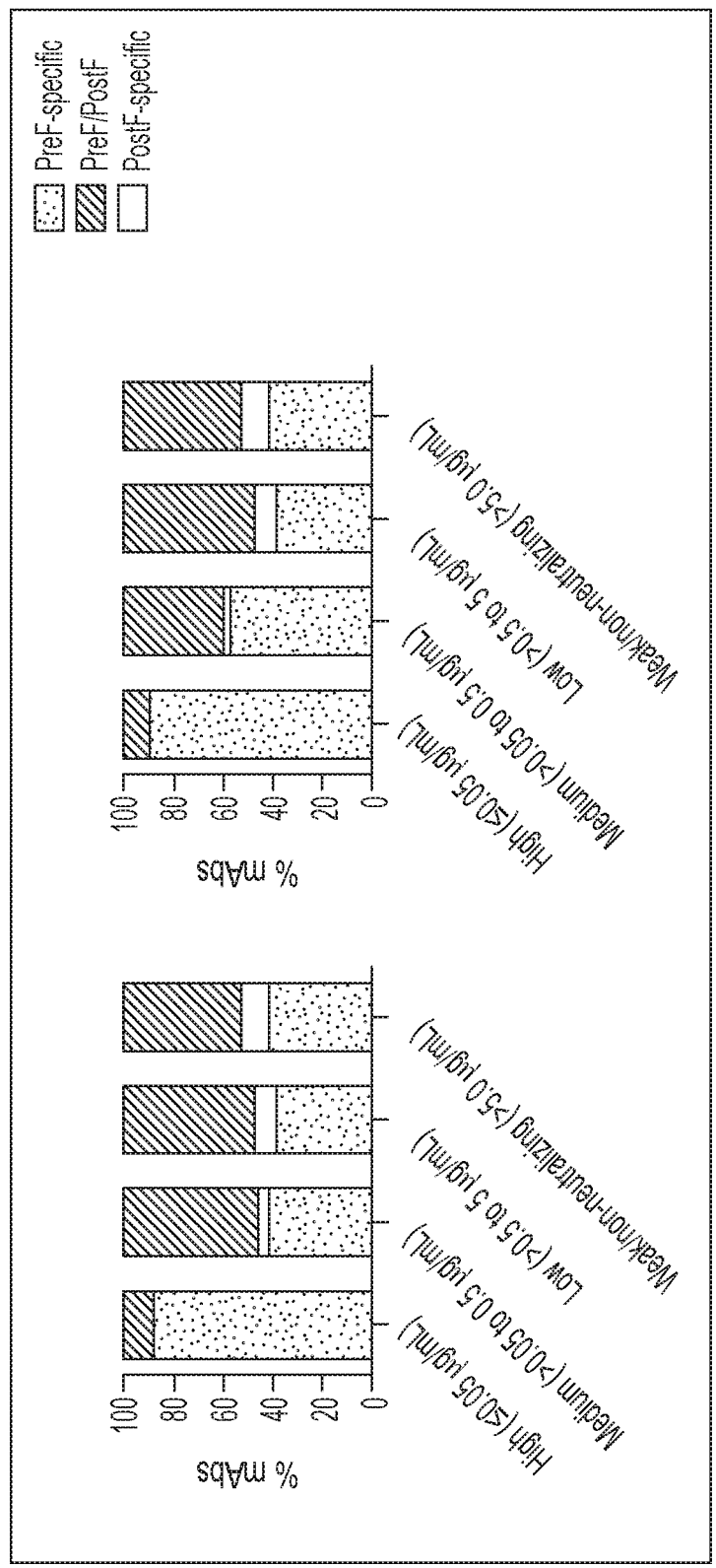

The relationship between preF- and postF-binding affinity and neutralization potency was next investigated, which clearly demonstrated that the majority of highly potent antibodies bound preferentially or exclusively to preF (see, e.g., FIG. 4D through FIG. 4G; Table 3). Quantifying this difference revealed that more than 80% of highly potent antibodies ($IC_{50}$<0.05 µg/ml) were specific for preF (See, e.g., FIG. 9; Table 3) and that the median $IC_{50}$ for preF-specific antibodies was more than 8-fold lower than for pre- and postF cross-reactive antibodies and 80-fold lower than antibodies that specifically recognized postF (see, e.g., FIG. 4E; Table 3). Importantly, there was a positive correlation between preF binding and neutralization (P<0.001, r=0.24), and the apparent preF $K_D$s generally corresponded well with the neutralization $IC_{50}$s (see, e.g., FIG. 5A; Table 3). In contrast, there was no correlation between neutralization potency and postF affinity (P=0.44, r=−0.07) (see, e.g., FIG. 5B; Table 3). This result is compatible with the occupancy model of antibody-mediated neutralization (47), and suggests that DS-Cav1 is a faithful antigenic mimic of the native preF trimer. Notably, very few antibodies neutralized with $IC_{50}$s lower than 100 pM, which is consistent with the previously proposed ceiling to affinity maturation (48, 49).

Figure 5C:
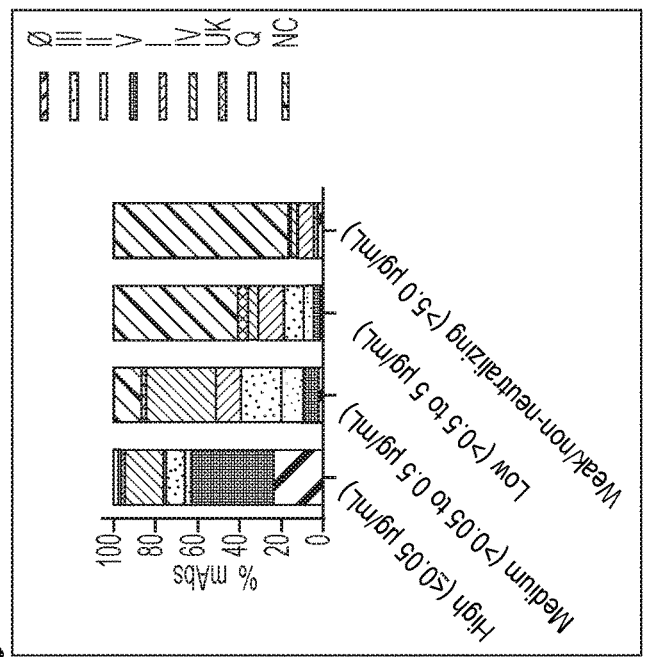
Figure 10B:
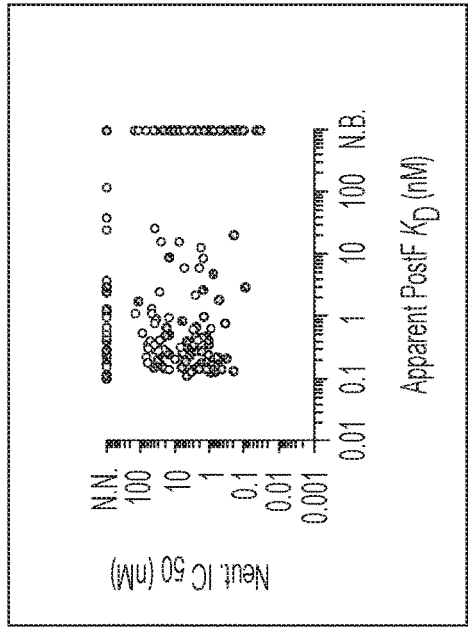
Figure 10A:
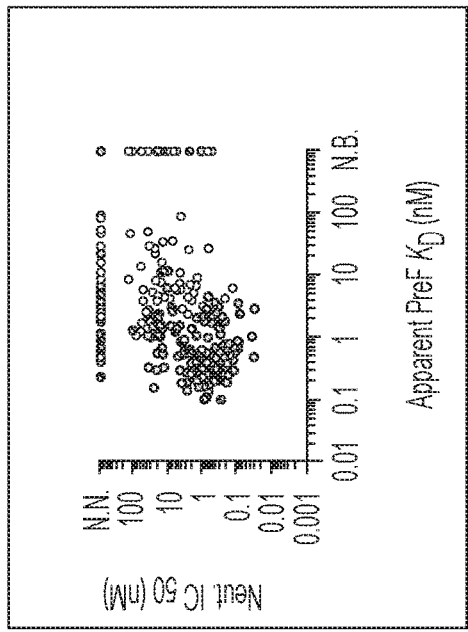
Figure 10C:
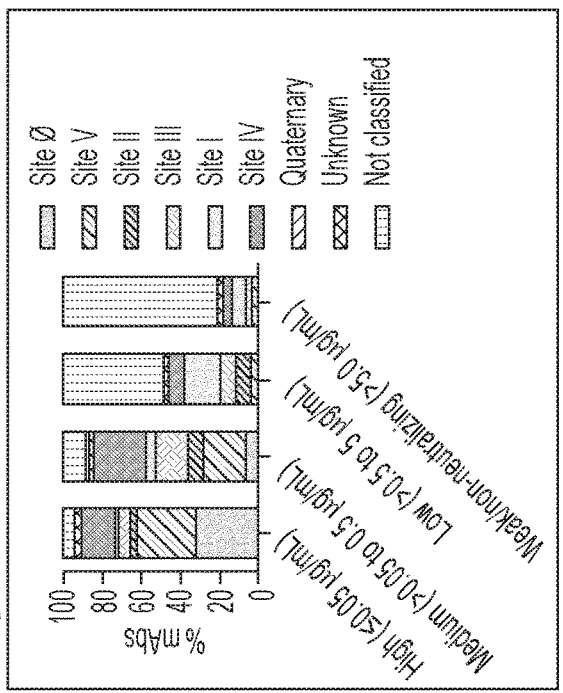

The relationship between neutralization potency and antigenic site was next analyzed. The results, provided in, e.g., FIG. 5C, Table 3, and Table 4, collectively, indicated that over 60% of the highly potent neutralizing antibodies targeted antigenic sites Ø and V, which are two of the three prefusion-F specific sites. In contrast, antibodies targeting sites III and IV showed a wide range of neutralization potencies, and antibodies targeting sites I and II were generally moderate to non-neutralizing. Similar results were obtained using binding affinities and neutralization potencies measured for subtype B (See, e.g., FIG. 10A through FIG. 10C; Table 3 and Table 4). Interestingly, a subset of site IV-directed antibodies neutralized with substantially lower potency than would be expected based on preF binding affinity (see, e.g., FIG. 5A; Table 3). This result may suggest that certain epitopes within site IV are less exposed in the context of the native envelope spike expressed on the crowded surface of the virion than on recombinant preF.

Several Antibodies Cross-Neutralize RSV and HMPV

Given that the RSV and human metapneumovirus (HMPV) F proteins share 33% amino acid identity, and certain RSV F-specific antibodies cross-neutralize HMPV (17, 50), the antibodies from this donor were tested for neutralizing activity against HMPV. Of the 133 antibodies tested, one neutralized HMPV (see, e.g., Table 5). Sequence analysis revealed that this antibody represents the VH1-46 germline gene and contains a significant degree of somatic hypermutation (See, e.g., Table 2 and sequence listing). This cross-neutralizing antibody bound to both the preF and PostF and competed with MPE8 (See, e.g., Table 5), in agreement with previous studies indicating that MPE8 cross-neutralizes four pneumoviruses, including RSV and HMPV (17). This result suggests, inter alia, that highly conserved epitopes are relatively immunogenic in the context of natural RSV and/or HMPV infection.

Affinity Maturation of RSV F-Specific Antibodies:

Some embodiments refer to affinity matured antibodies of any of the antibodies listed in Table 6 (each understood as a "parent" antibody" for producing an affinity matured variant). Affinity matured antibodies may be produced by mutagenesis of any one or more of the CDRs of the parent antibody. According to a specific embodiment, the invention provides for affinity matured variants comprising one or more point mutations e.g., 0, 1, 2, or 3 point mutations in each of the CDR sequences, of any of the antibodies listed in Table 6, or of an antibody comprising the six CDR sequences of any of the antibodies listed in Table 6. Affinity matured variants can be produced by any affinity maturation method employing standard mutagenesis techniques, e.g., for optimizing the binding characteristics, such as increasing affinity of binding, or increasing Kon, or decreasing Koff, and can be characterized by a $K_D$ difference of at least 2 fold, 5 fold, 1 log, or 2 logs, or 3 logs, as compared to the parent antibody. Such affinity matured antibodies still have the same binding specificity as the parent antibody and e.g., an optimized affinity of binding the target epitope.

Selected anti RSV antibodies were identified for affinity maturation. Oligos were ordered which comprised CDRH1, CDRH2, CDRH3, CDRL1, CDRL2, and CDRL3 sequences that were variegated via NNK diversity. The NNK oligos were incorporated into the parent HC or LC via DNA shuffling, as described previously (Stemmer W P et al., DNA shuffling by random fragmentation and reassembly: In vitro recombination for molecular evolution. Proc Natl Acad Sci USA. Oct. 25 1994; 91(22):10747-51). The library was then created by transforming the VH and VL PCR products into yeast already containing either the light chain or heavy chain plasmid of the parent. The diversified libraries were then selected using flow cytometry. For each FACS round, the libraries were affinity pressured using decreasing amounts of antigen and clones with improved binding affinities were sorted and propagated. Once improved binding populations were observed by flow cytometry (typically two rounds of selection), single yeast clones were be picked for sequencing and characterization (Table 6).

A specific embodiment refers to affinity matured variants of the antibody 267 in Table 6. Notably, each of the antibodies numbered 365-372 is an affinity matured variant of the antibody numbered 267 in Table 6.

Antibody Production and Purification of Affinity Matured Antibodies

Yeast clones were grown to saturation and then induced for 48 h at 30° C. with shaking. After induction, yeast cells were pelleted and the supernatants were harvested for purification. IgGs were purified using a Protein A column and eluted with acetic acid, pH 2.0. Fab fragments were generated by papain digestion and purified over KappaSelect (GE Healthcare LifeSciences).

RSV In Vitro Neutralization in ELISA Based Microneutralization Assays

Figure 11:
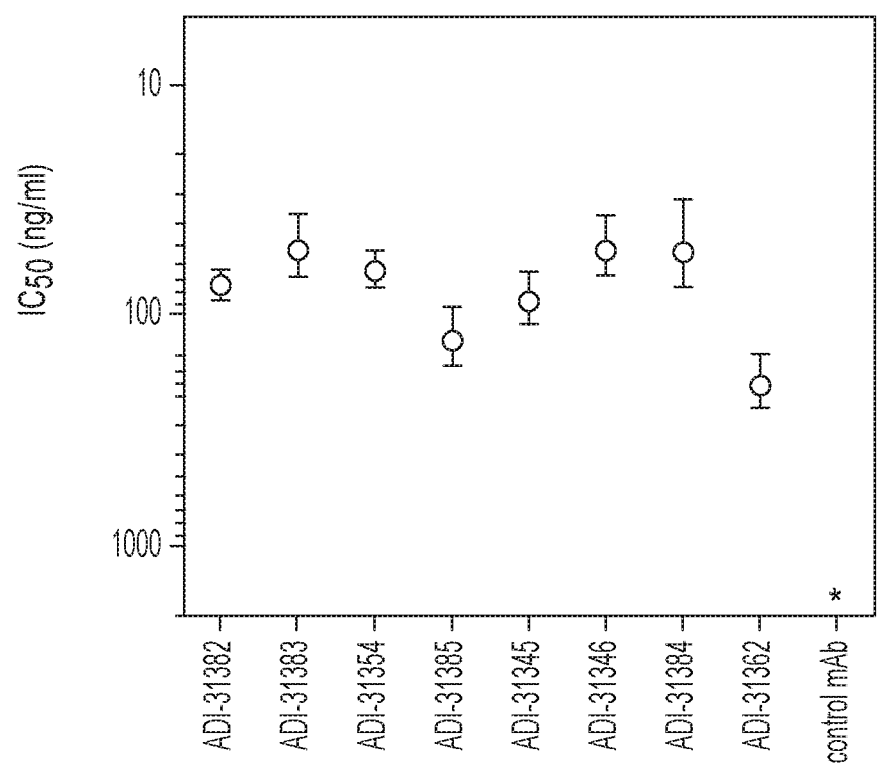

In vitro RSV neutralization was tested in ELISA based Microneutralization Assays using RSV-A strain A2 (ATCC, VR1540P). Virus (at a final multiplicity of infection of approximately 0.25) was added to 96-well plates containing serially diluted mAbs in serum-free MEM and pre-incubated for 30 min at 4° C. Freshly trypsinized Hep-2 cells (1.5×10$E^4$ cells/well) were then added to each well in MEM supplemented with 5% FCS. Following incubation for 4 days at 37° C. and 5% $CO_2$, medium was aspirated and cells were washed twice with 200 µl PBS/well, air-dried and fixed with 100 µl Acetone (80%). RSV replication was measured by quantification of expressed viral proteins by ELISA. For this purpose, fixed cells were washed 2× times with PBS-0.1% Tween-20, blocked with 1% skimmed milk in PBS for 1 hour at RT and then stained with a polyclonal goat-anti RSV antibody preparation (BioRad, #7950-0004) for 1 hour at RT in blocking buffer. A donkey anti-goat IgG HRP conjugate was used as detection reagent and 1 step-Ultra TMB (Thermo Fisher Scientific, #34209) as substrate. % inhibition of virus replication was calculated relative to control cells infected with virus in absence of neutralizing antibodies. An isotype matched control mAb was included in all experiments. mAb potency is expressed as half-maximal inhibitory concentration that resulted in 50% reduction in virus replication ($IC_{50}$). Results are provided in FIG. 11 and demonstrate that all mAbs were able to neutralize RSV-A2 in this setting, with a broad range of $IC_{50}$ values.

Discussion

An in-depth understanding of the human antibody response to RSV infection will aid the development and evaluation of RSV vaccine and therapeutic and/or prophylactic antibody candidates for the treatment and/or prevention of RSV infection. Although previous studies have coarsely mapped the epitopes targeted by RSV-specific neutralizing antibodies in human sera (4, 8), the specificities and functional properties of antibodies induced by natural RSV infection have remained largely undefined. As disclosed herein, preF- and postF-stabilized proteins (11, 15), a high-throughput antibody isolation platform, and a structure-guided collection of prefusion F mutants, were used to clonally dissect the human memory B cell response to RSV F in a naturally infected adult donor, and highly potent and selective RSV-neutralizing—as well as highly potent anti-RSV/anti-HMPV cross-selective and cross-neutralizing—were isolated and characterized.

Figure 2B:
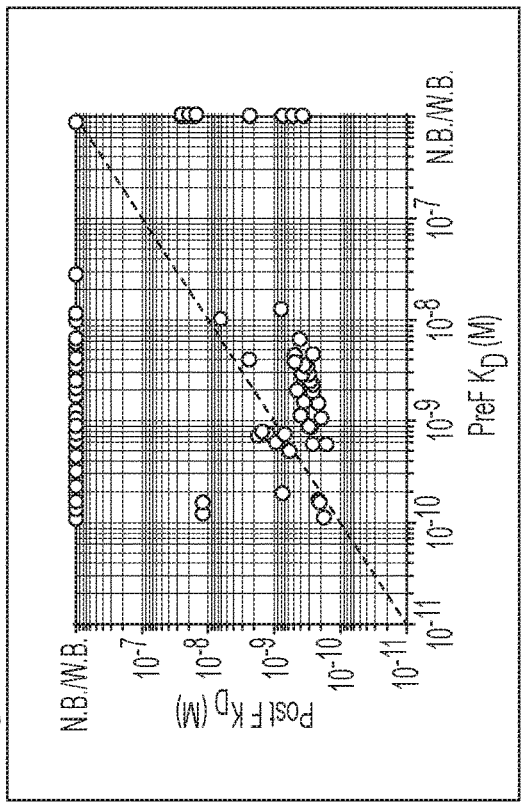
Figure 2C:
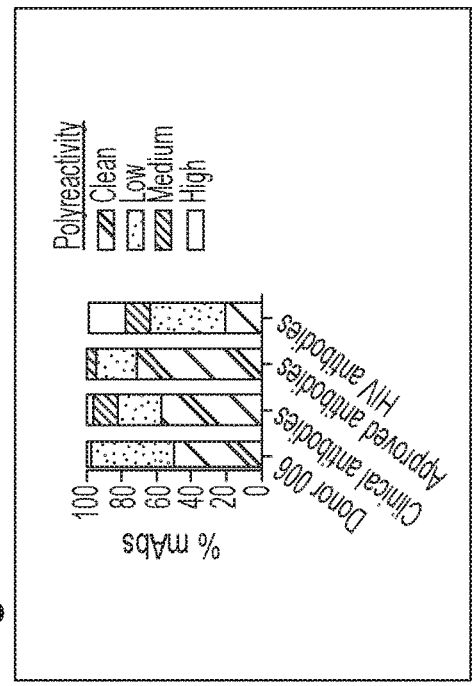
Figure 2D:
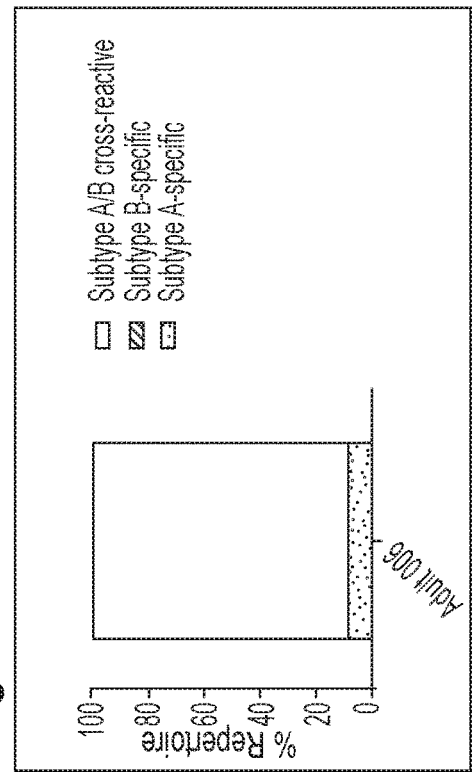
Figure 3B:
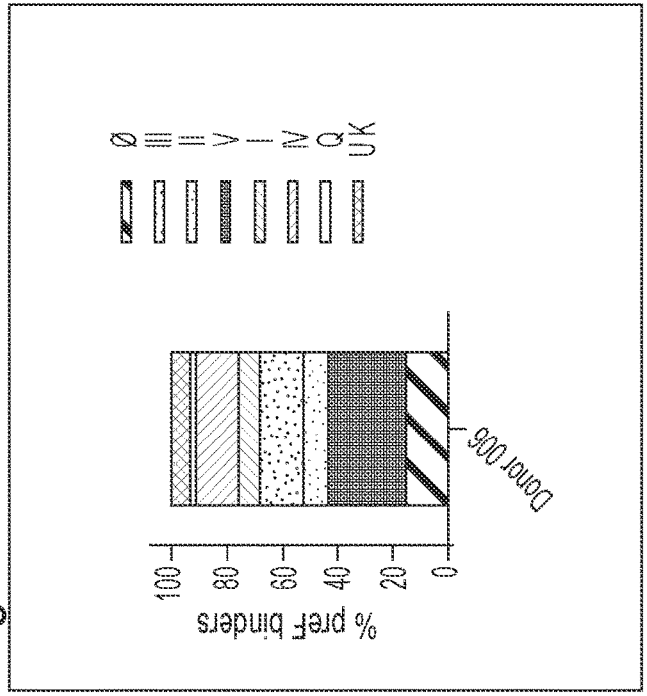
FIGS. 3A-3G illustrate mapping and specificities of anti-RSV antibodies for antigenic sites spanning the surface of PreF and PostF.
Figure 3A:
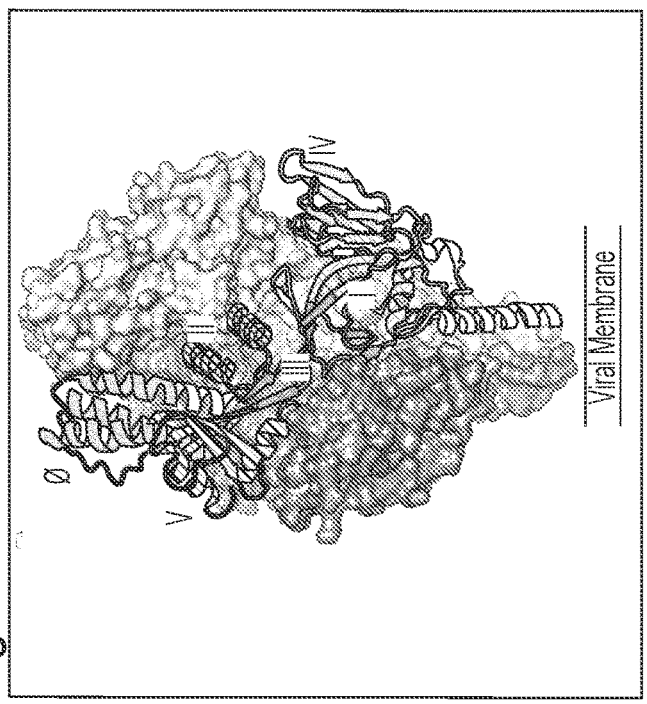
Figure 3C:
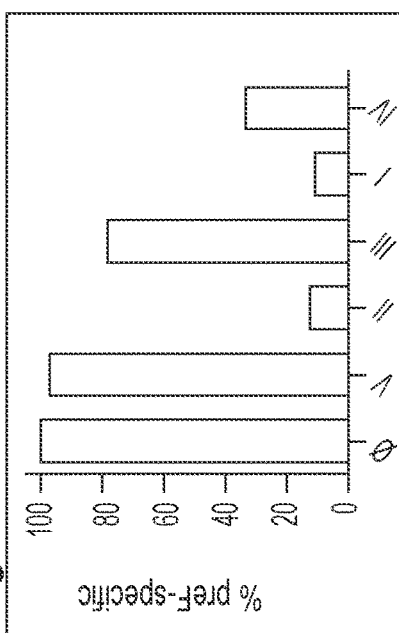
Figure 3D:
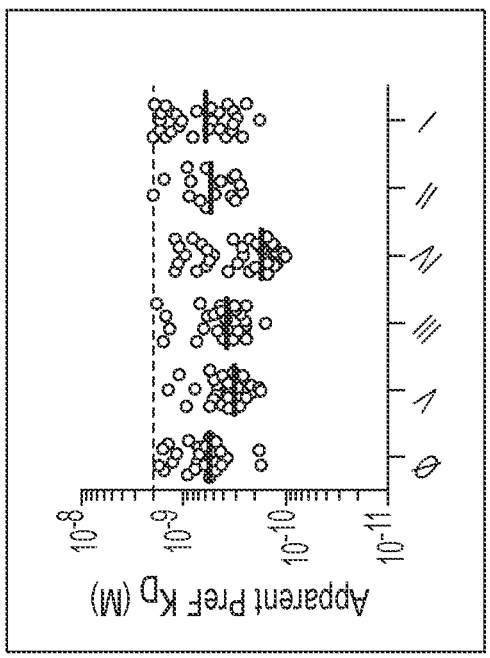
Figure 3F:
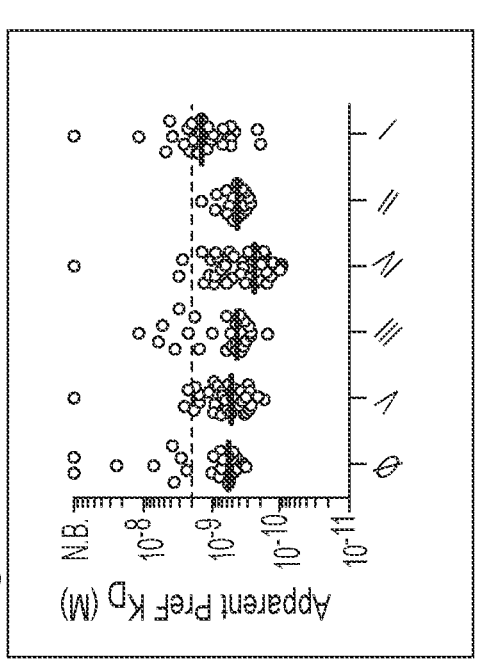
Figure 3E:
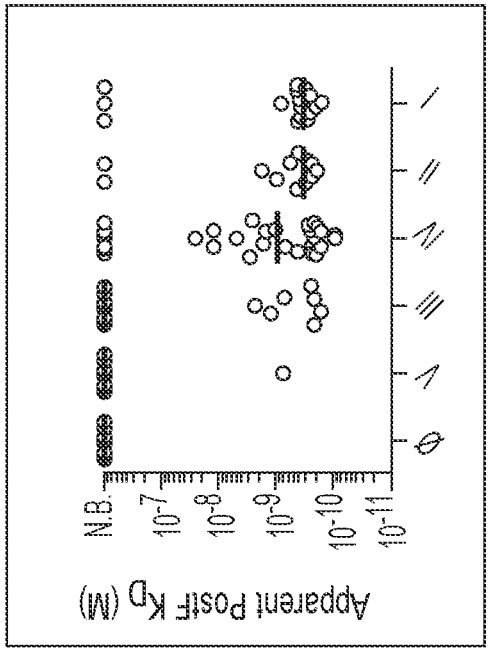
Figure 3G:
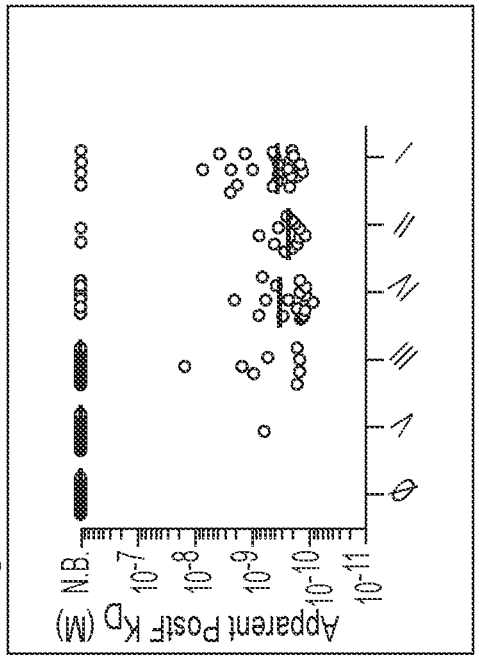

In the repertoire analyzed, the ratio of preF-specific antibodies to those that recognize both pre- and postF was slightly greater than 1:1 (See, e.g., FIG. 2B). These values are somewhat lower than those reported for human sera, which showed approximately 70% of anti-F serum binding is specific for preF (8). This discrepancy may be the result of differences between the levels of individual antibodies in serum, differences in the B cell phenotypes achieved for a particular specificity, or variation between donors. Despite these minor differences, the results of both studies suggest that preF-specific epitopes and epitopes shared by pre- and postF are immunogenic during natural RSV infection, whereas the unique surfaces on postF are significantly less immunogenic.

The repertoire analysis disclosed herein revealed that the large majority of RSV F-specific antibodies target six dominant antigenic sites on prefusion RSV F: Ø, I, II, III, IV, and V. These sites were defined based on previously determined structures, epitope binning/competition assays, resistance mutations, and secondary structure elements of the preF protein. It is important to note that the nomenclature for describing RSV F antigenic sites has evolved over time (6, 51-57), and previous mapping efforts were based on the postfusion conformation of F and did not include surfaces present exclusively on preF. The crystal structure of preF has provided critical information about F structure and function as well as new reagents to map antibody binding sites on the unique surfaces of preF and surfaces shared with postF. To a first approximation, each antibody can be assigned primarily to one of these sites. However, it is likely that antibody epitopes cover the entire surface of F and that there are antibodies that bind two or more adjacent antigenic sites within a protomer and quaternary antibodies that bind across protomers.

Importantly, the results disclosed herein show that the most potently neutralizing antibodies target antigenic sites Ø and V, both of which are located near the apex of the preF trimer. These findings are consistent with results obtained from human sera mapping, which determined that the majority of neutralizing activity can be removed by pre-incubation with preF (4, 8) and that preF-specific sites other than site Ø make up a considerable fraction of preF-specific neutralizing antibodies (8). Although antigenic site Ø has been shown to be a target of potently neutralizing antibodies (8, 10), the interaction of antibodies with site V is less well understood. Interestingly, it was found that the majority of site V-directed antibodies share several convergent sequence features, suggesting that it may be possible to rapidly detect these types of antibodies in human samples using high-throughput sequencing technology (58). Applicant anticipates this finding to be particularly advantageous in profiling antibody responses to RSV vaccine candidates that aim to preserve the apex of the preF trimer.

The extensive panel of antibodies described here provides new opportunities for passive prophylaxis, as well as for treatment of RSV infection. A large number of these antibodies neutralize RSV more potently than D25, which serves as the basis for MEDI8897—a monoclonal antibody that is currently in clinical trials for the prevention of RSV in young, at risk children (59). Additionally, a subset of these antibodies were demonstrated to cross-neutralize HMPV.

The development of an effective RSV vaccine has presented a number of unique challenges, and selection of the optimal vaccination strategy will be of the utmost importance. The in-depth analysis of the human antibody response to natural RSV infection presented here provides insights for the development of such a vaccine. Importantly, the results suggest that immunization of pre-immune donors with preF immunogens would be expected to boost neutralizing responses, whereas the use of postF immunogens would likely expand B cell clones with moderate or weak neutralizing activity. Similarly, immunization of RSV naïve infants with preF immunogens would be expected to activate naïve B cells targeting epitopes associated with substantially more potent neutralizing activity compared to postF immunogens. In addition, the ideal RSV vaccine should preserve antigenic sites Ø and V, since these sites are targeted by the most highly potent antibodies elicited in response to natural RSV infection.

Accordingly, disclosed herein are highly selective and potent anti-RSV antibodies, as well as highly potent cross-neutralizing anti-RSV and anti-HMPV antibodies, as well as vaccine candidates, for the treatment and or prophylaxis of RSV and/or HMPV infection. Additionally, the reagents disclosed here provide a useful set of tools for the evaluation of clinical trials, which will be critical for selecting the optimal RSV vaccination or antibody-based therapeutic strategy from the many currently under investigation (60).

TABLE 1

Antigenic sites targeted by prototypic RSV antibodies

| Antigenic site | Prototypic antibodies |
| --- | --- |
| Ø | D25, 5C4, AM22 (10, 16) |
| I | 131-2a, 2F |
| II | 1129, palivizumab, motavisumab (6) |
| III | MPE8 (17) |
| IV | 101F (57), mAb 19 (19) |

TABLE 2

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-18875 | 232 | VH4-34 | VK1-39 | AGTNYGEVNTSNQYFFGMDV | QQSYSTPLT | 4 | 10 | 8 |
| ADI-18876 | 233 | VH4-304 | VK3-20 | ARDVGTLVLPTVAYYYGMDV | QQYGSSPLVT | 44 | 12 | 4 |
| ADI-18877 | 234 | VH1-18 | VK2-30 | ARESGATAAAMFDY | MQAIHWPRT | 52 | 9 | 8 |
| ADI-18878 | 235 | VH4-304 | VK3-20 | ARDGGYDHVWGTHRYFDK | QQYGASPWT | 23 | 12 | 6 |
| ADI-18879 | 236 | VH1-18 | VK2-30 | ARDVPGHGAAFMDV | MQGTHWPPA | 46 | 9 | 12 |
| ADI-18880 | 237 | VH1-18 | VK2-30 | ARDPPAYAATLMDV | MQGTHWPPT | 36 | 8 | 7 |
| ADI-18882 | 238 | VH1-69 | VK3-20 | ARDAYEVWTGSYLPPFDY | QQYGSSFLT | 21 | 19 | 9 |
| ADI-18883 | 239 | VH1-69 | VK1-12 | ARVPESLVASNAYAV | QQGTSFPFT | 79 | 30 | 6 |
| ADI-18884 | 240 | VH1-3 | VK2-28 | ARGQIVVIPRANFWFDP | MQTLQTPIT | 57 | 8 | 1 |
| ADI-18885 | 241 | VH4-304 | VK3-20 | ARDGGYDHIWGTHRYFAL | QQYGTSPWT | 22 | 13 | 8 |
| ADI-18887 | 242 | VH1-69 | VK1-9 | ARVFFGTCGGASCFPSDL | QQLHSDFQT | 76 | 20 | 8 |
| ADI-18888 | 243 | VH3-33 | VK3-20 | ARDHASTPYYMDV | QQYGSFPWT | 24 | 8 | 10 |
| ADI-18889 | 244 | VH4-34 | VK1-39 | AGTNVGFVNTHYYFGMDV | QQSYSVPLT | 3 | 25 | 12 |
| ADI-18890 | 245 | VH1-69 | VK3-20 | ARDAYEVWTGSYLPPFDY | QQYGSSFLT | 21 | 27 | 10 |
| ADI-18891 | 246 | VH1-69 | VK3-20 | ARDAYEVWTGSYLPPFDY | QQYGSSFLT | 21 | 22 | 10 |
| ADI-18892 | 247 | VH1-18 | VK2-30 | ARDSFSLTGAGFPDY | MQATQWPRT | 39 | 7 | 1 |
| ADI-18893 | 248 | VH3-21 | VL1-40 | ARLGYGGNPELDY | QSYDLSLSSSRV | 61 | 8 | 3 |
| ADI-18894 | 249 | VH3-30 | VL1-40 | ARGASYYYVSSDLGY | QSYDSLSASWV | 54 | 11 | 5 |
| ADI-18895 | 250 | VH5-51 | VK1-33 | ASVMLRGIM | QPYDNLPPPLT | 84 | 12 | 1 |
| ADI-18896 | 251 | VH3-30 | VK3-15 | ARAPYDIWSGYCLDY | QQYSIWPQT | 16 | 10 | 6 |
| ADI-18897 | 252 | VH3-7 | VK4-1 | ARDTPDVLRHLEWPPVGAFDI | QQYYSSPQT | 42 | 11 | 8 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-18898 | 253 | VH1-18 | VK2-30 | ARESGATAAAMFDY | MQAIHWPRT | 52 | 9 | 8 |
| ADI-18899 | 254 | VH3-30 | VK3-15 | ARAPYDIWSGYCLDY | QQYSIWPQT | 16 | 10 | 6 |
| ADI-18900 | 255 | VH3-23 | VK1-5 | ARDQEVELIDDAFDF | QQYYTYYS | 38 | 22 | 7 |
| ADI-18901 | 256 | VH1-2 | VL1-51 | ARSSLVGASPNFDF | GTWDASLSAAMV | 72 | 18 | 8 |
| ADI-18902 | 257 | VH4-59 | VL3-21 | ARSTWDYGDHFPFDY | QVWDSSPDHPYV | 73 | 8 | 7 |
| ADI-18903 | 258 | VH1-18 | VK2-30 | ARDVPGHGAAFMDV | MQGTHWPPA | 46 | 9 | 12 |
| ADI-18904 | 259 | VH1-18 | VK2-30 | ARDPPAYAATLMDV | MQGTHWPPT | 36 | 8 | 7 |
| ADI-18905 | 260 | VH4-39 | VK1-5 | ACKRADADDVDYVAGLTGFPWYFDV | QQYHVYFPLT | 1 | 29 | 2 |
| ADI-18906 | 261 | VH3-33 | VK3-20 | ARDHASTPYYMDV | QQYGSFPWT | 24 | 8 | 10 |
| ADI-18907 | 262 | VH1-69 | VK3-11 | ARGCCGAVAGFQH | QQRTTGVT | 55 | 21 | 7 |
| ADI-18908 | 263 | VH3-21 | VL1-40 | VRGVLPGGTGGGWFDS | QSYDYSLNWV | 98 | 16 | 7 |
| ADI-18909 | 264 | VH4-304 | VK3-20 | ARDLGKPLWDGHYYYGVDV | QVYSSSPPIT | 27 | 13 | 9 |
| ADI-18910 | 265 | VH1-69 | VK2-28 | ARTAALGPPGTIVGYMDV | MQTLQTPWT | 74 | 8 | 3 |
| ADI-18911 | 266 | VH5-51 | VK1-33 | ARLGIGAAARNY | LQFDNLPPT | 60 | 12 | 7 |
| ADI-18912 | 267 | VH3-21 | VL1-40 | ARDLLPVERGPAFDI | QSYDSRLGGSV | 31 | 6 | 3 |
| ADI-18913 | 268 | VH5-51 | VK1-39 | ARQIGGLVCSSESCYFYGMDV | QQSDTTPFT | 67 | 13 | 6 |
| ADI-18915 | 269 | VH3-15 | VL1-40 | ATDSRRLYDSRGFYSSAFDV | QSYDDSLTGWV | 86 | 4 | 3 |
| ADI-18916 | 270 | VH5-51 | VK1-39 | ARQIGGLVCSSESCYFYGMDV | QQSDTTPFT | 67 | 13 | 6 |
| ADI-18917 | 271 | VH3-21 | VL1-40 | VRGVLPGDTGGGWFDS | QSYDYSLNWV | 98 | 16 | 7 |
| ADI-18918 | 272 | VH5-51 | VK3-15 | ARLPVGSYYYFNL | QQYNNWLSWT | 62 | 8 | 13 |
| ADI-18919 | 273 | VH4-31 | VK2-28 | ARTSYAGRMLDR | MQGLQIPWT | 75 | 22 | 4 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-18920 | 274 | VH3-30 | VL1-51 | AKVRNEAWELLGDALDV | GTWDTSLRAGV | 12 | 10 | 14 |
| ADI-18921 | 275 | VH1-24 | VK1-39 | ATPTPVGATDY | QQSYIIPYT | 88 | 15 | 2 |
| ADI-18922 | 276 | VH4-b | VK3-15 | ASRRGSGWFFDS | QQYNNWPPGGT | 83 | 22 | 8 |
| ADI-18923 | 277 | VH3-21 | VL1-40 | ARDWPNSSSSPNWFDP | QSYDSSLSGFYV | 48 | 0 | 0 |
| ADI-18924 | 278 | VH5-51 | VL1-40 | ARCSLSCDYYGVNL | QSYDSSLSGFYV | 18 | 9 | 11 |
| ADI-18925 | 279 | VH3-30 | VK3-11 | AKPIVGPTTGYFDY | QQRSNWYT | 9 | 8 | 0 |
| ADI-18926 | 280 | VH1-18 | VK2-30 | ARDPPASAAAMLDY | MQGTHGRGIS | 36 | 19 | 8 |
| ADI-18927 | 281 | VH1-2 | VK1-13 | ASQSSPYTPGALDV | QQSFTPQFT | 82 | 21 | 21 |
| ADI-18928 | 282 | VH1-69 | VL7-46 | ARDIEWFVLMDPITSYYPMDV | LLSYSGARPV | 25 | 15 | 8 |
| ADI-18929 | 283 | VH3-11 | VL1-44 | ARDAVIVVGPVAVHYQYYADV | AAWDDSLNGPV | 19 | 9 | 6 |
| ADI-18930 | 284 | VH1-69 | VK3-20 | ARDAYEVWTGSYLPPFDY | QQYGSSFLT | 21 | 14 | 8 |
| ADI-18931 | 285 | VH3-49 | VK3-15 | TRDDILTGFYDRSYYYGIHV | QQYDNWPPYT | 92 | 6 | 6 |
| ADI-18932 | 286 | VH4-304 | VK3-11 | ARDLGTLAFDPYYYYGIDV | QQRSTWPT | 29 | 25 | 10 |
| ADI-18933 | 287 | VH1-46 | VK1-39 | ARRGYPDSGSYPLDY | QQSYIRPIT | 69 | 26 | 10 |
| ADI-18935 | 288 | VH4-304 | VK3-11 | ARDLGYSSSSPAFYYGIDF | QQRSNGVLT | 30 | 19 | 6 |
| ADI-18936 | 289 | VH1-8 | VK1-39 | ASQSSPYTPGAMGV | QLNSGALFT | 82 | 26 | 12 |
| ADI-18937 | 290 | VH4-304 | VK3-20 | ARDVGVYSGYDVFHYYGMDV | QQYGGSPPVT | 45 | 25 | 10 |
| ADI-18938 | 291 | VH3-74 | VK1-5 | ARDLWTTSPYFDL | QQYNSWA | 32 | 15 | 10 |
| ADI-18939 | 292 | VH4-34 | VK1-39 | AGTNYGEVNTSNQYFFGMDV | QQSYSAPLT | 4 | 3 | 7 |
| ADI-18940 | 293 | VH1-8 | VK1-39 | ASQSSPYTPGAMDV | QLNSGALFT | 82 | 33 | 14 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-18941 | 294 | VH5-51 | VK3-15 | GQAVAGGEYFHH | QHYNNWPRG | 90 | 7 | 5 |
| ADI-18942 | 295 | VH4-304 | VK3-11 | ARDLGTANNYYFGMDV | QQRSNWPPYT | 28 | 19 | 6 |
| ADI-18943 | 296 | VH4-b | VK3-20 | AGAFWEVWTGLYSPPFDF | QQYSSSPLT | 2 | 38 | 7 |
| ADI-18944 | 297 | VH1-18 | VK2-30 | ARDPAVDAIPMLDY | MQGTHWPLT | 34 | 20 | 8 |
| ADI-18946 | 298 | VH3-30 | VL2-14 | AKEEWLVPAY | SSYSTNSAP | 7 | 8 | 3 |
| ADI-18947 | 299 | VH3-30 | VK3-15 | ARAPYDIWSGYCLDY | QQYSIWPQT | 16 | 16 | 7 |
| ADI-18948 | 300 | VH3-30 | VK3-15 | ARAPYDIWSGYCLDY | QQYSIWPQT | 16 | 13 | 7 |
| ADI-18949 | 301 | VH1-18 | VK2-30 | ARDPAVDAIPMLDY | MQGTHWPLT | 34 | 20 | 8 |
| ADI-18950 | 302 | VH4-39 | VK3-11 | ATAWTFDH | QLRGHWPPTIT | 85 | 13 | 2 |
| ADI-18951 | 303 | VH3-23 | VL2-14 | AKDGLRDVSRVYYIDV | SSYRNGNALGV | 5 | 19 | 16 |
| ADI-18952 | 304 | VH3-23 | VL2-14 | AKDGLRDLSRVYYIDV | SSYRNGNTLGV | 5 | 18 | 11 |
| ADI-18953 | 305 | VH1-69 | VK3-20 | ARDAYEVWTGSYLPPFDY | QQYGSSFLT | 21 | 12 | 11 |
| ADI-18955 | 306 | VH3-30 | VK3-15 | ARAPYDIWSGYCLDY | QQYSIWPQT | 16 | 11 | 6 |
| ADI-18956 | 307 | VH1-69 | VL2-11 | ATRLYTLGSPFDN | CSYAGRYIYV | 89 | 23 | 10 |
| ADI-18957 | 308 | VH3-21 | VL1-40 | ARVHVDLVTTIFGVDFDF | QSYDSSLSGAI | 78 | 12 | 3 |
| ADI-18958 | 309 | VH1-18 | VK2-30 | AREPPSDDAARLFDY | MQGTQWPVT | 51 | 18 | 3 |
| ADI-18959 | 310 | VH1-24 | VK1-39 | ATPTPVGATDF | QQTYIIPYT | 88 | 18 | 4 |
| ADI-18960 | 311 | VH4-39 | VL3-21 | AREGPNWELLNAFDI | QVWDTSSDHVN | 50 | 15 | 5 |
| ADI-18962 | 312 | VH3-21 | VL1-40 | ARVSTELGYYYMDV | QSYDSSLSVV | 80 | 1 | 0 |
| ADI-18965 | 313 | VH1-3 | VK4-1 | GRDWDGAIRVLDY | QQYYGNFPT | 91 | 14 | 9 |
| ADI-18966 | 314 | VH3-30 | VK2-30 | ARDPGVGSYYNVVGMDV | MQGTHWPPT | 35 | 13 | 3 |
| ADI-18967 | 315 | VH1-24 | VK1-39 | ATPLPAGALDK | QQTYIIPYT | 88 | 23 | 12 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-18968 | 316 | VH4-304 | VK3-11 | TRDLGYSTSSPSFYYGMDV | QQRTNWPIT | 93 | 17 | 8 |
| ADI-18969 | 317 | VH1-18 | VK2-30 | ARDVFSKTAARIFDY | MQATDWPVT | 43 | 15 | 4 |
| ADI-18970 | 318 | VH4-304 | VK3-11 | ARDIGYGDHGTGSYYYGIED | QQRTNWIT | 26 | 6 | 9 |
| ADI-18971 | 319 | VH3-23 | VL3-21 | AKDRVGWFGEFDAFDF | QVWDSRSEHVI | 6 | 17 | 12 |
| ADI-18972 | 320 | VH1-18 | VK2-30 | ARDPAVDAIPMLDY | MQGTHWPLT | 34 | 20 | 8 |
| ADI-18973 | 321 | VH2-70 | VK3-20 | ALMRPFWSRDDYYYSIAV | QLYHRSPGSASQTVWT | 13 | 18 | 14 |
| ADI-18974 | 322 | VH1-18 | VK2-30 | ARDTPATAAPLLDY | MQGIFRPGT | 41 | 22 | 5 |
| ADI-18975 | 323 | VH1-18 | VK2-24 | ARDSGCCSGSTSDV | MQATEFPPMYT | 40 | 11 | 3 |
| ADI-18976 | 324 | VH4-31 | VK1-39 | ARDNKHHDSGNYYAYFDH | QQSYTTRLT | 33 | 5 | 9 |
| ADI-18977 | 325 | VH1-3 | VK1-33 | ARQVSTGWHATSHRFAP | QQYDNLPLT | 68 | 17 | 6 |
| ADI-18978 | 326 | VH3-30 | VK1-5 | AKSSSSHVNSRQDK | QQYYNWWT | 11 | 9 | 11 |
| ADI-18979 | 327 | VH1-18 | VK2-30 | ARDSFSETGTGFPDF | MQATHRPRT | 39 | 11 | 1 |
| ADI-18980 | 328 | VH5-51 | VK3-11 | AKSNVGNTGWNY | QEVRNWPPCT | 10 | 8 | 9 |
| ADI-18981 | 329 | VH4-30 | VK3-20 | ARCGNEYGEVHPFDI | QQYGSSPWT | 17 | 27 | 9 |
| ADI-18982 | 330 | VH1-18 | VK2-30 | ARDSFSETGTGFPDF | MQATHRPRT | 39 | 7 | 1 |
| ADI-18983 | 331 | VH3-30 | VK1-17 | AREAYEEWELTMGNLDH | LQHNRYPFT | 49 | 14 | 5 |
| ADI-18984 | 332 | VH4-61 | VK1-12 | ARGEHFAYWWGN | QQANSFPRT | 56 | 29 | 5 |
| ADI-18985 | 333 | VH1-2 | VK1-39 | TSQTSPYTPGAMGV | QQTYNGLIA | 95 | 22 | 16 |
| ADI-18986 | 334 | VH3-30 | VL1-40 | ARGASYYYVSSDLGY | QSYDSLSASWV | 54 | 12 | 5 |
| ADI-18987 | 335 | VH1-69 | VK3-20 | ARDAYEVWTGSYLPPFDD | QQYGSSFLT | 20 | 12 | 8 |
| ADI-18988 | 336 | VH3-21 | VL1-40 | VREAYASSSALYWFDP | QSYDSSLSGWV | 97 | 22 | 6 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-18989 | 337 | VH3-48 | VK2-28 | ARSLGSGNYDNEDQTFYYYYGMDV | MQALQTPYT | 71 | 14 | 6 |
| ADI-18990 | 338 | VH4-304 | VK3-11 | ARDLGTANNYYFGMDV | QQRSNWPPYT | 28 | 19 | 6 |
| ADI-18991 | 339 | VH4-304 | VL3-21 | ASGPVGMATSNWFDP | QVWDSSTDYHVV | 81 | 22 | 14 |
| ADI-18992 | 340 | VH1-46 | VL1-40 | ARAPSHDEWVAISRNVVGFDA | QSYDSSLSAWV | 15 | 14 | 7 |
| ADI-18993 | 341 | VH3-21 | VL1-40 | AREVLPATAIGGAWLDP | QSYDISLSASYV | 53 | 10 | 7 |
| ADI-18994 | 342 | VH1-18 | VL2-23 | ARIGHVTAVAGAPPDY | CSYVAGSTSV | 58 | 13 | 7 |
| ADI-18995 | 343 | VH4-304 | VL3-21 | ASGPVGMATSNWFDP | QVWDSGTDYHVV | 81 | 18 | 12 |
| ADI-18996 | 344 | VH1-2 | VL1-51 | ARSSLVGASPNFDF | GTWDASLSAAMV | 72 | 17 | 10 |
| ADI-18997 | 345 | VH4-34 | VK3-15 | ARVHPSYDFGWRFFDF | QQYAYWPPYT | 77 | 16 | 9 |
| ADI-18998 | 346 | VH4-304 | VL3-21 | ASGPVGMATSNWFDP | QVWDSSTDHHVV | 81 | 15 | 15 |
| ADI-18999 | 347 | VH1-69 | VL2-11 | ARPNYDILTGYAFDI | CSYAGGLYV | 65 | 13 | 3 |
| ADI-19000 | 348 | VH1-8 | VL1-36 | VQMDHCRSTSCSEGNWFDT | AAWDDSLNVWV | 96 | 10 | 6 |
| ADI-19001 | 349 | VH3-49 | VL2-8 | TRQDDFWSGHPYYFEY | SSYAGSNDLGV | 94 | 10 | 7 |
| ADI-19002 | 350 | VH4-59 | VK1-39 | ARQFGYDKNTLSRLDFDY | QQSYSIPWT | 66 | 17 | 8 |
| ADI-19003 | 351 | VH4-39 | VL3-21 | AREGPNWELLNAFDI | QVWDTSSDHVV | 50 | 15 | 4 |
| ADI-19004 | 352 | VH1-18 | VK2-30 | ARDPPASAAAMLDY | MQGTHGRGIS | 36 | 19 | 7 |
| ADI-19005 | 353 | VH1-18 | VK1-39 | ASQSSPYTPGAMGV | QLNSGALFT | 82 | 21 | 9 |
| ADI-19006 | 354 | VH3-11 | VK3-20 | ARAKTSYYFYALDV | QRYGNSWP | 14 | 30 | 12 |
| ADI-19007 | 355 | VH3-23 | VK4-1 | AKESLDFGSGSYNWFDT | HQYYDTHT | 8 | 18 | 5 |
| ADI-19008 | 356 | VH3-30 | VK3-11 | ARDPSLGYNNHYFDY | QQRSNWPPMYS | 37 | 15 | 6 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-19009 | 357 | VH1-69 | VK3-20 | ARDAYEVWTGSYLPPFDY | QQYGSSFLT | 21 | 19 | 6 |
| ADI-19010 | 358 | VH3-21 | VL1-40 | ARDVQYSGYDSGYYFDY | QSYDSSLSALYV | 47 | 0 | 0 |
| ADI-19011 | 359 | VH3-30 | VL4-60 | ATIRGIVAGLCDN | EAWDFNTGGV | 87 | 19 | 9 |
| ADI-19012 | 360 | VH4-4 | VK1-39 | ARLSGNCSGGSCYSPFDH | QQSYNTVYT | 63 | 12 | 10 |
| ADI-19013 | 361 | VH5-51 | VK1-12 | ARPMTTQEGFDL | QQTNSFLPLT | 64 | 4 | 2 |
| ADI-19014 | 362 | VH4-304 | VK3-20 | ARSADIDIVWGSSLYMPL | QQYGTSPWT | 70 | 21 | 10 |
| ADI-19016 | 363 | VH3-21 | VL1-40 | ARIGYSSAHHYQYYMDV | QSYDKSLSGGYC | 59 | 13 | 5 |
| ADI-19017 | 364 | VH1-18 | VL3-25 | ASQSSPYTPGAMGV | QSADSSGTYPVV | 82 | 22 | 0 |

TABLE 3

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (µg/ml) subtype A* | Neut $IC_{50}$ (µg/ml) subtype B* |
|---|---|---|---|---|---|---|---|
| ADI-18875 | 232 | 7.36E-10 | NB | 7.64E-10 | NB | 0.040 | 0.035 |
| ADI-18876 | 233 | 7.07E-10 | 1.71E-09 | 3.16E-10 | 1.79E-10 | 0.037 | 0.179 |
| ADI-18877 | 234 | 3.03E-10 | NB | 3.83E-10 | NB | 0.410 | 0.130 |
| ADI-18878 | 235 | 4.53E-09 | 4.83E-10 | 5.82E-09 | 3.88E-10 | >10 | 8.308 |
| ADI-18879 | 236 | 3.12E-10 | NB | 3.58E-10 | NB | 0.041 | 0.103 |
| ADI-18880 | 237 | 2.55E-10 | NB | 3.04E-10 | NB | 0.041 | 0.055 |
| ADI-18882 | 238 | 4.27E-10 | NB | 4.76E-10 | NB | 0.041 | 0.057 |
| ADI-18883 | 239 | 4.31E-10 | NB | 5.66E-10 | NB | 0.041 | 0.050 |
| ADI-18884 | 240 | 3.38E-10 | NB | 2.04E-10 | NB | 0.073 | 0.239 |
| ADI-18885 | 241 | 2.18E-09 | 3.84E-10 | 3.89E-09 | 3.07E-10 | 0.376 | 8.635 |
| ADI-18887 | 242 | NB | 7.43E-10 | 1.22E-08 | 5.49E-10 | 1.110 | >10 |
| ADI-18888 | 243 | NB | 2.54E-08 | NB | 1.16E-09 | >10 | >10 |
| ADI-18889 | 244 | 5.54E-10 | NB | 5.87E-10 | NB | 0.040 | 0.019 |
| ADI-18890 | 245 | 4.89E-10 | NB | 4.58E-10 | NB | 0.041 | 0.041 |
| ADI-18891 | 246 | 5.34E-10 | NB | 5.13E-10 | NB | 0.012 | 0.026 |
| ADI-18892 | 247 | 2.17E-10 | NB | 2.53E-10 | NB | 0.018 | 0.117 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (μg/ml) subtype A* | Neut $IC_{50}$ (μg/ml) subtype B* |
|---|---|---|---|---|---|---|---|
| ADI-18893 | 248 | 2.45E−10 | NB | 2.78E−10 | NB | 0.123 | 0.182 |
| ADI-18894 | 249 | 2.54E−09 | NB | 3.27E−10 | NB | 0.345 | 0.123 |
| ADI-18895 | 250 | NB | 2.37E−09 | NB | 4.86E−10 | 2.303 | >10 |
| ADI-18896 | 251 | 2.27E−09 | 2.79E−10 | 1.81E−09 | 2.70E−10 | 1.100 | 4.722 |
| ADI-18897 | 252 | 1.47E−09 | 2.19E−10 | 1.53E−09 | 1.85E−10 | 0.288 | 0.762 |
| ADI-18898 | 253 | 3.05E−10 | NB | 3.25E−10 | NB | 0.030 | 0.097 |
| ADI-18899 | 254 | 1.92E−09 | 2.66E−10 | 1.59E−09 | 2.51E−10 | 0.742 | 2.700 |
| ADI-18900 | 255 | 1.19E−09 | NB | 3.31E−10 | NB | 0.035 | 0.059 |
| ADI-18901 | 256 | 2.17E−09 | NB | NB | NB | 5.646 | 5.762 |
| ADI-18902 | 257 | 1.07E−10 | NB | 1.01E−10 | NB | 0.024 | 0.150 |
| ADI-18903 | 258 | 3.24E−10 | NB | 2.72E−10 | NB | 0.036 | 0.118 |
| ADI-18904 | 259 | 2.51E−10 | NB | 2.37E−10 | NB | 0.018 | 0.089 |
| ADI-18905 | 260 | 3.38E−09 | NB | NB | NB | 0.685 | 3.676 |
| ADI-18906 | 261 | NB | 2.33E−08 | NB | 1.10E−09 | >10 | >10 |
| ADI-18907 | 262 | 1.74E−10 | NB | 2.04E−10 | NB | 3.300 | >10 |
| ADI-18908 | 263 | 3.02E−10 | NB | 3.52E−10 | NB | 0.018 | 0.095 |
| ADI-18909 | 264 | 5.08E−10 | 5.81E−10 | 2.88E−10 | 2.25E−10 | 0.110 | 0.169 |
| ADI-18910 | 265 | 4.67E−09 | NB | 1.06E−08 | NB | >10 | 0.767 |
| ADI-18911 | 266 | NB | 3.53E−10 | NB | 2.80E−10 | 0.301 | 4.853 |
| ADI-18912 | 267 | 2.58E−10 | NB | 2.86E−10 | NB | 0.024 | 0.061 |
| ADI-18913 | 268 | 5.68E−10 | NB | 4.71E−10 | NB | <0.01 | <0.01 |
| ADI-18915 | 269 | 2.81E−08 | NB | 4.21E−10 | NB | 1.199 | 0.021 |
| ADI-18916 | 270 | 5.85E−10 | NB | 4.65E−10 | NB | <0.01 | <0.01 |
| ADI-18917 | 271 | 3.56E−10 | NB | 3.32E−10 | NB | 0.024 | 0.091 |
| ADI-18918 | 272 | NB | 5.67E−10 | NB | 4.09E−10 | 0.377 | 4.590 |
| ADI-18919 | 273 | 2.02E−10 | NB | 1.63E−10 | NB | 0.123 | 0.261 |
| ADI-18920 | 274 | 6.78E−10 | NB | 9.77E−11 | NB | 0.041 | 0.049 |
| ADI-18921 | 275 | 5.75E−09 | NB | NB | NB | 1.703 | 1.172 |
| ADI-18922 | 276 | 3.47E−09 | 3.22E−10 | 5.27E−09 | 2.87E−10 | >10 | 5.051 |
| ADI-18923 | 277 | 5.17E−10 | NB | 1.79E−09 | NB | 0.078 | 0.147 |
| ADI-18924 | 278 | 6.48E−09 | 4.11E−10 | NB | 3.21E−10 | 0.572 | 1.073 |
| ADI-18925 | 279 | 4.99E−09 | NB | NB | NB | >10 | >10 |
| ADI-18926 | 280 | 2.52E−10 | NB | 2.50E−10 | NB | 0.023 | 0.092 |
| ADI-18927 | 281 | 3.58E−09 | NB | 2.99E−09 | NB | 0.022 | 0.067 |
| ADI-18928 | 282 | 4.49E−10 | NB | 5.15E−10 | NB | 0.034 | 0.062 |
| ADI-18929 | 283 | 1.61E−09 | NB | NB | NB | 0.261 | 0.369 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut IC$_{50}$ (μg/ml) subtype A* | Neut IC$_{50}$ (μg/ml) subtype B* |
|---|---|---|---|---|---|---|---|
| ADI-18930 | 284 | 3.87E−10 | NB | 3.72E−10 | NB | 0.013 | 0.051 |
| ADI-18931 | 285 | 5.65E−10 | NB | 4.88E−10 | NB | >10 | >10 |
| ADI-18932 | 286 | 9.17E−10 | NB | 1.39E−09 | NB | 0.184 | 0.351 |
| ADI-18933 | 287 | NB | 2.00E−08 | NB | 6.16E−10 | 0.075 | 0.137 |
| ADI-18935 | 288 | 6.60E−10 | NB | 5.82E−10 | NB | 0.779 | 0.355 |
| ADI-18936 | 289 | 3.03E−10 | NB | 2.98E−10 | NB | 0.032 | 0.035 |
| ADI-18937 | 290 | 2.89E−10 | NB | 2.73E−10 | NB | 0.084 | 0.508 |
| ADI-18938 | 291 | 1.65E−10 | 2.16E−10 | 1.50E−10 | 1.68E−10 | 0.837 | 4.255 |
| ADI-18939 | 292 | 5.74E−10 | NB | 5.60E−10 | NB | 0.018 | 0.038 |
| ADI-18940 | 293 | 1.12E−09 | NB | 1.56E−09 | NB | 0.023 | 0.063 |
| ADI-18941 | 294 | NB | 1.91E−08 | NB | 6.45E−10 | >10 | >10 |
| ADI-18942 | 295 | 8.65E−10 | 2.81E−10 | 5.12E−10 | 2.58E−10 | 0.374 | 0.614 |
| ADI-18943 | 296 | 6.46E−10 | NB | 7.25E−10 | NB | 0.027 | 0.043 |
| ADI-18944 | 297 | 3.09E−10 | NB | 3.37E−10 | NB | 0.026 | 0.074 |
| ADI-18946 | 298 | 1.58E−10 | 2.06E−10 | 1.57E−10 | 1.66E−10 | 0.093 | 0.227 |
| ADI-18947 | 299 | 2.45E−09 | 2.96E−10 | 2.20E−09 | 2.82E−10 | 1.299 | 3.602 |
| ADI-18948 | 300 | 4.55E−09 | 2.57E−10 | 2.10E−09 | 2.47E−10 | 1.123 | 4.346 |
| ADI-18949 | 301 | 3.07E−10 | NB | 3.08E−10 | NB | 0.040 | 0.076 |
| ADI-18950 | 302 | 1.13E−09 | 3.93E−10 | 4.18E−09 | 3.85E−10 | >10 | >10 |
| ADI-18951 | 303 | 7.52E−10 | 1.29E−09 | 5.35E−09 | 1.13E−09 | 3.398 | >10 |
| ADI-18952 | 304 | 7.15E−10 | 7.29E−10 | 1.01E−09 | 6.33E−10 | 1.589 | 2.745 |
| ADI-18953 | 305 | 5.13E−10 | NB | 4.21E−10 | NB | 0.034 | 0.022 |
| ADI-18955 | 306 | 5.99E−10 | 2.56E−10 | 2.37E−09 | 2.50E−10 | 1.933 | 3.116 |
| ADI-18956 | 307 | 1.82E−10 | NB | 2.24E−10 | NB | >10 | >10 |
| ADI-18957 | 308 | 4.69E−10 | NB | 3.24E−10 | NB | 1.339 | 6.084 |
| ADI-18958 | 309 | 2.86E−10 | NB | 3.02E−10 | NB | 0.587 | 3.364 |
| ADI-18959 | 310 | 4.68E−09 | NB | NB | NB | 7.214 | 2.258 |
| ADI-18960 | 311 | 1.78E−10 | NB | 1.83E−10 | NB | 0.034 | 0.107 |
| ADI-18962 | 312 | 8.83E−09 | NB | 2.28E−08 | NB | 4.439 | >10 |
| ADI-18965 | 313 |  | NB | NB | NB | 3.023 | 6.892 |
| ADI-18966 | 314 | 5.78E−10 | NB | 5.62E−10 | NB | 0.044 | 0.130 |
| ADI-18967 | 315 | 8.09E−10 | NB | NB | NB | 6.737 | 3.651 |
| ADI-18968 | 316 | 1.98E−09 | 4.38E−10 | 6.02E−10 | 3.05E−10 | 0.909 | 0.541 |
| ADI-18969 | 317 | 3.03E−10 | NB | 2.97E−10 | NB | 0.035 | 0.187 |
| ADI-18970 | 318 | 1.04E−08 | 6.84E−09 | 4.45E−10 | 4.12E−10 | >10 | 0.333 |
| ADI-18971 | 319 | 1.57E−10 | NB | 1.68E−10 | NB | 0.039 | 0.114 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut IC$_{50}$ (µg/ml) subtype A* | Neut IC$_{50}$ (µg/ml) subtype B* |
|---|---|---|---|---|---|---|---|
| ADI-18972 | 320 | 2.98E−10 | NB | 3.68E−10 | NB | 0.016 | 0.107 |
| ADI-18973 | 321 | 3.78E−09 | 4.95E−10 | 2.63E−09 | 3.94E−10 | 9.605 | 6.273 |
| ADI-18974 | 322 | 2.53E−10 | NB | 2.90E−10 | NB | 0.030 | 0.105 |
| ADI-18975 | 323 | 2.67E−10 | NB | 2.98E−10 | NB | 0.037 | 0.174 |
| ADI-18976 | 324 | 4.03E−09 | 2.36E−09 | 1.24E−09 | 2.09E−10 | 6.290 | 10.600 |
| ADI-18977 | 325 | 7.86E−10 | NB | 9.66E−10 | NB | 0.108 | 0.117 |
| ADI-18978 | 326 | 3.00E−09 | NB | NB | NB | >10 | >10 |
| ADI-18979 | 327 | 1.89E−10 | NB | 1.84E−10 | NB | 0.012 | 0.031 |
| ADI-18980 | 328 | NB | 5.33E−10 | NB | 3.50E−10 | 3.599 | >10 |
| ADI-18981 | 329 | 1.53E−09 | 3.53E−10 | 1.15E−09 | 2.80E−10 | >10 | >10 |
| ADI-18982 | 330 | 1.92E−10 | 7.65E−10 | 1.95E−10 | 7.47E−10 | 0.018 | 0.053 |
| ADI-18983 | 331 | 1.71E−09 | NB | 5.81E−10 | NB | 0.028 | 0.075 |
| ADI-18984 | 332 | 1.29E−08 | 8.03E−10 | 6.08E−09 | 6.59E−10 | >10 | >10 |
| ADI-18985 | 333 | 5.66E−10 | NB | 1.70E−09 | NB | 0.034 | 0.090 |
| ADI-18986 | 334 | 2.68E−09 | NB | 2.38E−10 | NB | 0.464 | 0.123 |
| ADI-18987 | 335 | 4.49E−10 | NB | 5.24E−10 | NB | 0.015 | 0.027 |
| ADI-18988 | 336 | 2.93E−10 | NB | 3.70E−10 | NB | 0.089 | 0.370 |
| ADI-18989 | 337 | 3.51E−09 | 3.56E−10 | 3.92E−09 | 3.77E−10 | >10 | >10 |
| ADI-18990 | 338 | 8.90E−10 | 2.94E−10 | 4.91E−10 | 2.52E−10 | 0.580 | 0.845 |
| ADI-18991 | 339 | 1.35E−10 | | 1.52E−10 | | 0.028 | 0.228 |
| ADI-18992 | 340 | 7.66E−10 | 1.53E−09 | 9.69E−10 | 9.07E−10 | 2.546 | 5.692 |
| ADI-18993 | 341 | 2.55E−10 | NB | 2.77E−10 | NB | 0.078 | 0.128 |
| ADI-18994 | 342 | 3.10E−10 | NB | 3.31E−10 | NB | 0.047 | 0.108 |
| ADI-18995 | 343 | 1.20E−10 | 1.23E−08 | 1.27E−10 | | 0.043 | 0.125 |
| ADI-18996 | 344 | 2.52E−09 | NB | 3.60E−09 | NB | >10 | >10 |
| ADI-18997 | 345 | 5.01E−09 | NB | 5.32E−09 | NB | >10 | >10 |
| ADI-18998 | 346 | 1.57E−10 | 1.24E−08 | 1.72E−10 | NB | 0.055 | 0.458 |
| ADI-18999 | 347 | 5.92E−10 | 1.67E−10 | 1.02E−09 | 1.41E−10 | 1.805 | 6.465 |
| ADI-19000 | 348 | 1.10E−10 | 1.75E−10 | 1.04E−10 | 1.28E−10 | 0.037 | 0.129 |
| ADI-19001 | 349 | 1.07E−09 | 1.93E−10 | 1.06E−09 | 1.49E−10 | >10 | 3.259 |
| ADI-19002 | 350 | 1.63E−09 | NB | NB | NB | 2.886 | 4.507 |
| ADI-19003 | 351 | 1.61E−10 | NB | 1.68E−10 | NB | 0.047 | 0.125 |
| ADI-19004 | 352 | 2.28E−10 | NB | 2.73E−10 | NB | 0.020 | 0.128 |
| ADI-19005 | 353 | 9.63E−10 | NB | 9.64E−10 | NB | 0.041 | 0.110 |
| ADI-19006 | 354 | 1.75E−09 | NB | NB | NB | 4.891 | 5.059 |
| ADI-19007 | 355 | 6.18E−10 | 9.69E−10 | 6.08E−10 | 4.57E−10 | 0.208 | 0.370 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut IC$_{50}$ (μg/ml) subtype A* | Neut IC$_{50}$ (μg/ml) subtype B* |
|---|---|---|---|---|---|---|---|
| ADI-19008 | 356 | 3.63E-09 | NB | NB | NB | 8.293 | >10 |
| ADI-19009 | 357 | 4.42E-10 | NB | 4.66E-10 | NB | 0.062 | 0.066 |
| ADI-19010 | 358 | 6.04E-09 | NB | 2.84E-09 | NB | >10 | 0.650 |
| ADI-19011 | 359 | 2.15E-09 | NB | NB | NB | >10 | 6.237 |
| ADI-19012 | 360 | 2.89E-09 | 3.04E-10 | 1.14E-09 | 3.14E-10 | >10 | >10 |
| ADI-19013 | 361 | NB | 1.61E-08 | NB | 5.83E-10 | 9.504 | >10 |
| ADI-19014 | 362 | 2.82E-09 | 3.59E-10 | 2.21E-09 | 2.77E-10 | 1.745 | >10 |
| ADI-19016 | 363 | NB | NB | NB | NB | 0.052 | 0.092 |
| ADI-19017 | 364 | 1.10E-08 | NB | 7.20E-09 | NB | 1.562 | 0.795 |

*NN; non-neutralizing, NB; non-binding, ND; not determined. IgG KDs were calculated for antibodies with BLI binding responses with BLI binding responses >0.1 nm. Antibodies with BLI binding responses <0.05 nm were designated as NB.

TABLE 4

Bin, patch, and antigenic site assignments for anti-RSV antibodies

| Name | Antibody number (Ab #) | Bin Assignment | Patch Assignment | Antigenic Site Assignment |
|---|---|---|---|---|
| ADI-18875 | 232 | D25 | 1, 2 | Ø |
| ADI-18876 | 233 | Mota | 5 | II |
| ADI-18877 | 234 | D25/mota/MPE8 | 4 | V |
| ADI-18878 | 235 | 101F/13390 | | |
| ADI-18879 | 236 | D25/mota/MPE8 | 4 | V |
| ADI-18880 | 237 | D25/mota/MPE8 | 4 | V |
| ADI-18882 | 238 | D25 | 1, 2 | Ø |
| ADI-18883 | 239 | D25 | 4 | V |
| ADI-18884 | 240 | 14469 | | I |
| ADI-18885 | 241 | 101F/13390 | | |
| ADI-18887 | 242 | Mota/13390 | | |
| ADI-18888 | 243 | Mota/101F/13390 | | |
| ADI-18889 | 244 | D25 | 1, 2 | Ø |
| ADI-18890 | 245 | D25 | 2 | Ø |
| ADI-18891 | 246 | D25 | 2, 1 | Ø |
| ADI-18892 | 247 | Mota/MPE8 | 4 | V |
| ADI-18893 | 248 | Mota/MPE8 | | III |
| ADI-18894 | 249 | D25 | | |
| ADI-18895 | 250 | Unknown | | |
| ADI-18896 | 251 | 101F/13390 | | |
| ADI-18897 | 252 | Mota/101F/13390 | | III |
| ADI-18898 | 253 | D25/mota/MPE8 | 4 | V |
| ADI-18899 | 254 | 101F/13390 | | I |
| ADI-18900 | 255 | D25 | 1 | Ø |
| ADI-18901 | 256 | Unknown | | |
| ADI-18902 | 257 | 14443 | 9 | IV |
| ADI-18903 | 258 | D25/mota/MPE8 | 4, 3 | V |
| ADI-18904 | 259 | D25/mota/MPE8 | 4 | V |
| ADI-18905 | 260 | MPE8 | | |
| ADI-18906 | 261 | Mota/101F/13390 | | |
| ADI-18907 | 262 | | | UK |
| ADI-18908 | 263 | Mota/MPE8 | | III |
| ADI-18909 | 264 | Mota | 5 | II |
| ADI-18910 | 265 | Unknown | | |
| ADI-18911 | 266 | Mota | | |
| ADI-18912 | 267 | Mota/MPE8 | | III |
| ADI-18913 | 268 | D25 | 1 | Ø |
| ADI-18915 | 269 | D25/mota | | |
| ADI-18916 | 270 | D25 | 1 | Ø |
| ADI-18917 | 271 | Mota/MPE8 | | III |
| ADI-18918 | 272 | Mota | | |
| ADI-18919 | 273 | | | UK |
| ADI-18920 | 274 | 101F | 9 | IV |
| ADI-18921 | 275 | 101F | | |
| ADI-18922 | 276 | Mota | | |
| ADI-18923 | 277 | Mota/MPE8/101F | | III |
| ADI-18924 | 278 | Unknown | | |
| ADI-18925 | 279 | 101F | | |
| ADI-18926 | 280 | D25/mota/MPE8 | 4 | V |
| ADI-18927 | 281 | D25/mota | | |
| ADI-18928 | 282 | D25 | 1, 2 | Ø |
| ADI-18929 | 283 | 101F | 1 | UK |
| ADI-18930 | 284 | D25 | 1, 2 | Ø |
| ADI-18931 | 285 | 101F | | IV |
| ADI-18932 | 286 | Mota | 5 | II |
| ADI-18933 | 287 | Unknown | | |
| ADI-18935 | 288 | Mota | 6, 5 | III |
| ADI-18936 | 289 | D25/mota | 4 | V |
| ADI-18937 | 290 | Mota | 5 | II |
| ADI-18938 | 291 | Mota/101F | | III |
| ADI-18939 | 292 | D25 | 9 | Ø |
| ADI-18940 | 293 | D25/mota | 1, 2 | V |
| ADI-18941 | 294 | Mota | | |
| ADI-18942 | 295 | Mota | | II |
| ADI-18943 | 296 | D25 | 5 | UK |
| ADI-18944 | 297 | D25/mota/MPE8 | 1, 2 | V |
| ADI-18946 | 298 | 101F | 4 | IV |
| ADI-18947 | 299 | 101F/13390 | | |
| ADI-18948 | 300 | 101F/13390 | | |
| ADI-18949 | 301 | D25/mota/MPE8 | 4 | V |
| ADI-18950 | 302 | 13390 | | I |
| ADI-18951 | 303 | Mota/13390 | | III |
| ADI-18952 | 304 | Mota/13390 | | III |
| ADI-18953 | 305 | D25 | 2 | Ø |
| ADI-18955 | 306 | 101F/13390 | | I |
| ADI-18956 | 307 | 14469 | | I |
| ADI-18957 | 308 | Mota/MPE8 | | III |
| ADI-18958 | 309 | Mota | 4 | V |
| ADI-18959 | 310 | 14443 | | |
| ADI-18960 | 311 | 14469 | 9 | IV |
| ADI-18962 | 312 | Mota/MPE8 | | |
| ADI-18965 | 313 | Unknown | | |

TABLE 4-continued

Bin, patch, and antigenic site assignments for anti-RSV antibodies

| Antibody Name | Antibody number (Ab #) | Bin Assignment | Patch Assignment | Antigenic Site Assignment |
|---|---|---|---|---|
| ADI-18966 | 314 | D25/mota/MPE8 | 4 | V |
| ADI-18967 | 315 | 101F | 9 | IV |
| ADI-18968 | 316 | Mota | 5 | II |
| ADI-18969 | 317 | D25/mota/MPE8 | 4 | V |
| ADI-18970 | 318 | Mota/MPE8 | | |
| ADI-18971 | 319 | 14469 | 9 | IV |
| ADI-18972 | 320 | D25/mota/MPE8 | 4 | V |
| ADI-18973 | 321 | 13390 | | |
| ADI-18974 | 322 | D25/mota/MPE8 | 4 | V |
| ADI-18975 | 323 | D25/mota/MPE8 | 4 | V |
| ADI-18976 | 324 | 13390 | | |
| ADI-18977 | 325 | D25/mota | 4 | V |
| ADI-18978 | 326 | 14469 | | |
| ADI-18979 | 327 | Mota/MPE8 | 4 | V |
| ADI-18980 | 328 | Mota | | |
| ADI-18981 | 329 | 101F/13390 | | I |
| ADI-18982 | 330 | Mota/MPE8 | 4 | V |
| ADI-18983 | 331 | 101F | 3, 9 | Q |
| ADI-18984 | 332 | 13390 | | |
| ADI-18985 | 333 | D25/mota | 4 | V |
| ADI-18986 | 334 | D25 | | |
| ADI-18987 | 335 | D25 | | Ø |
| ADI-18988 | 336 | Mota/MPE8 | | III |
| ADI-18989 | 337 | 101F/13390 | | |
| ADI-18990 | 338 | Mota | 5 | II |
| ADI-18991 | 339 | 14443 | 9 | IV |
| ADI-18992 | 340 | 101F | | IV |
| ADI-18993 | 341 | Mota/MPE8 | | III |
| ADI-18994 | 342 | Mota/MPE8 | | III |
| ADI-18995 | 343 | 14443 | | IV |
| ADI-18996 | 344 | Unknown | | |
| ADI-18997 | 345 | D25/mota | | |
| ADI-18998 | 346 | 14443 | 9 | IV |
| ADI-18999 | 347 | 101F | 9 | IV |
| ADI-19000 | 348 | 14443 | 9 | IV |
| ADI-19001 | 349 | 101F/13390 | | I |
| ADI-19002 | 350 | Unknown | | UK |
| ADI-19003 | 351 | 14469 | 9 | IV |
| ADI-19004 | 352 | D25/mota/MPE8 | 4 | V |
| ADI-19005 | 353 | D25/mota | | V |
| ADI-19006 | 354 | Unknown | | UK |
| ADI-19007 | 355 | Mota/MPE8 | 5 | II |
| ADI-19008 | 356 | Unknown | | |
| ADI-19009 | 357 | D25 | 1 | Ø |
| ADI-19010 | 358 | Mota/MPE8 | | |
| ADI-19011 | 359 | Unknown | | |
| ADI-19012 | 360 | 13390 | | |
| ADI-19013 | 361 | Unknown | | |
| ADI-19014 | 362 | 101F/13390 | | |
| ADI-19015 | 363 | Mota/MPE8 | | |
| ADI-19017 | 364 | D25/mota | | |

TABLE 5

A subset of anti-RSV F antibodies cross-neutralize human metapneumovirus.

| Antibody Name | Antibody number (Ab #) | HMPV-A1 IC$_{50}$ (µg/ml) | RSV-A2 IC$_{50}$ (µg/ml) | Prefusion RSV F K$_D$ (M) | Postfusion RSV F K$_D$ (M) | RSV F Binding Site |
|---|---|---|---|---|---|---|
| ADI-18992 | | 6.1 | 2.5 | 7.6 × 10$^{-10}$ | 1.5 × 10$^{-9}$ | IV* |
| MPE8 Control | | N/A | 0.07 | 0.04 | — | — | — |

N/A, not applicable
*Binding site assignment based on competition only.

Materials and Methods

Study Design

To profile the antibody response to RSV F, peripheral blood mononuclear cells were obtained from a adult donor approximately between 20-35 years of age, and monoclonal antibodies from RSV F-reactive B cells were isolated therefrom. The antibodies were characterized by sequencing, binding, epitope mapping, and neutralization assays. All samples for this study were collected with informed consent of volunteers. This study was unblinded and not randomized. At least two independent experiments were performed for each assay.

Generation of RSV F Sorting Probes

The soluble prefusion and postfusion probes were based on the RSV F ΔFP and DS-Cav1 constructs that we previously crystallized and determined to be in the pre- and postfusion conformations, respectively (11, 15). To increase the avidity of the probes and to uniformly orient the RSV F proteins, the trimeric RSV F proteins were coupled to tetrameric streptavidin through biotinylation of a C-terminal AviTag. For each probe, both a C-terminal His-Avi tagged version and a C-terminal StrepTagII version were co-transfected into FreeStyle 293-F cells. The secreted proteins were purified first over Ni-NTA resin to remove trimers lacking the His-Avi tag. The elution from the Ni-NTA purification was then purified over Strep-Tactin resin. Due to the low avidity of a single StrepTagII for the Strep-Tactin resin, additional washing steps were able to remove singly StrepTagged trimers. This resulted in the purification of trimers containing two StrepTagII tagged monomers and therefore only one His-Avi tagged monomer. This purification scheme results in a single AviTag per trimer which greatly reduces the aggregation or 'daisy-chaining' that occurs when trimeric proteins containing three AviTags are incubated with tetrameric streptavidin. RSV F trimers were biotinylated using biotin ligase BirA according to the manufacturer's instructions (Avidity, LLC). Biotinylated proteins were separated from excess biotin by size-exclusion chromotography on a Superdex 200 column (GE Healthcare). Quantification of the number of biotin moieties per RSV F trimer was performed using the Quant*Tag Biotin Kit per the manufacturer's instructions (Vector Laboratories).

Single B-Cell Sorting

Peripheral blood mononuclear cells were stained using anti-human IgG (BV605), IgA (FITC), CD27 (BV421), CD8 (PerCP-Cy5.5), CD14 (PerCP-Cy5.5), CD19 (PECy7), CD20 (PECy7) and a mixture of dual-labeled DS-Cav1 and F ΔFP tetramers (50 nM each). Dual-labeled RSV F tetramers were generated by incubating the individual AviTagged RSV F proteins with premium-grade phycoerythrin-labeled streptavidin (Molecular Probes) or premium-grade allophycocyanin-labeled streptavidin for at least 20 minutes on ice at a molar ratio of 4:1. Tetramers were prepared fresh for each experiment. Single cells were sorted on a BD fluorescence-activated cell sorter Aria II into 96-well PCR plates (BioRad) containing 20 µL/well of lysis buffer [5 µL of 5× first strand cDNA buffer (Invitrogen), 0.25 µL RNaseOUT (Invitrogen), 1.25 µL dithiothreitol (Invitrogen), 0.625 µL NP-40 (New England Biolabs), and 12.6 µL dH$_2$O]. Plates were immediately frozen on dry ice before storage at −80° C.

Amplification and Cloning of Antibody Variable Genes

Single B cell PCR was performed as described previously (22). Briefly, IgH, Igλ and Igκ variable genes were amplified by RT-PCR and nested PCR reactions using cocktails of IgG and IgA-specific primers (22). The primers used in the second round of PCR contained 40 base pairs of 5' and 3' homology to the cut expression vectors to allow for cloning by homologous recombination into *Saccharomyces cerevisiae* (40). PCR products were cloned into *S. cerevisiae* using the lithium acetate method for chemical transformation (41). Each transformation reaction contained 20 μL of unpurified heavy chain and light chain PCR product and 200 ng of cut heavy and light chain plasmids. Following transformation, individual yeast colonies were picked for sequencing and characterization.

Expression and Purification of IgGs and Fab Fragments

Anti-RSV F IgGs were expressed in *S. cerevisiae* cultures grown in 24-well plates, as described previously (23). Fab fragments used for competition assays were generated by digesting the IgGs with papain for 2 h at 30° C. The digestion was terminated by the addition of iodoacetamide, and the Fab and Fc mixtures were passed over Protein A agarose to remove Fc fragments and undigested IgG. The flowthrough of the Protein A resin was then passed over CaptureSelect™ IgG-CH1 affinity resin (ThermoFischer Scientific), and eluted with 200 mM acetic acid/50 mM NaCl pH 3.5 into ⅛th volume 2M Hepes pH 8.0. Fab fragments then were buffer-exchanged into PBS pH 7.0.

Biolayer Interferometry Binding Analysis

IgG binding to DS-Cav1 and FΔ FP was determined by BLI measurements using a FortéBio Octet HTX instrument (Pall Life Sciences). For high-throughput $K_D$ screening, IgGs were immobilized on AHQ sensors (Pall Life Sciences) and exposed to 100 nM antigen in PBS containing 0.1% BSA (PBSF) for an association step, followed by a dissociation step in PBSF buffer. Data was analyzed using the FortéBio Data Analysis Software 7. The data was fit to a 1:1 binding model to calculate an association and dissociation rate, and $K_D$ was calculated using the ratio $k_d/k_a$.

Antibody Competition Assays

Antibody competition assays were performed as previously described (23). Antibody competition was measured by the ability of a control anti-RSV F Fab to inhibit binding of yeast surface-expressed anti-RSV F IgGs to either DS-Cav1 or FΔ FP. 50 nM biotinylated DS-Cav1 or FΔ FP was pre-incubated with 1 μM competitor Fab for 30 min at room temperature and then added to a suspension of yeast expressing anti-RSV F IgG. Unbound antigen was removed by washing with PBS containing 0.1% BSA (PBSF). After washing, bound antigen was detected using streptavidin Alexa Fluor 633 at a 1:500 dilution (Life Technologies) and analyzed by flow cytometry using a FACSCanto II (BD Biosciences). The level of competition was assessed by measuring the fold reduction in antigen binding in the presence of competitor Fab relative to an antigen-only control. Antibodies were considered competitors when a greater than five-fold reduction was observed in the presence of control Fab relative to an antigen-only control.

Expression, Purification and Biotinylation of PreF Patch Variants

A panel of 9 patches of 2-4 mutations uniformly covering the surface of the preF molecule was designed based on the structure of prefusion RSV F (10). For known antigenic sites, including those recognized by motavizumab, 101F, D25, AM14 and MPE8, patches incorporated residues associated with viral escape or known to be critical for antibody binding. Residues with high conservation across 184 subtype A, subtype B and bovine RSV F sequences were avoided where possible to minimize the likelihood of disrupting protein structure. The mutations present in each patch variant are shown in FIG. 7A. Mutations for each patch variant were cloned into the prefusion stabilized RSV F (DS-Cav1) construct with a C-terminal AviTag for site specific biotinylation. Proteins were secreted from FreeStyle 293-F cells, purified over Ni-NTA resin and biotinylated using biotin ligase BirA according to the manufacturer's instructions (Avidity, LLC). Biotinylated proteins were separated from excess biotin by size-exclusion chromotography on a Superdex 200 column (GE Healthcare). A deglycosylated version of DS-Cav1 was produced by expressing DS-Cav1 in the presence of 1 μM kifunensine and digesting with 10% (wt/wt) EndoH before biotinylation.

Luminex Assay for Patch Variant Binding

Binding of isolated antibodies to the patch variants was determined using a high-throughput Luminex assay. Each biotinylated variant and a DS-Cav1 control were coupled to avidin coated MagPlex beads (Bio-Rad), each with a bead identification number reflecting a unique ratio of red and infrared dyes embedded within the bead. The coupled beads were then mixed with a six-fold serial dilution of each antibody, ranging from 400 nM to 1.4 pM, in a 384-well plate. Beads were washed using a magnetic microplate washer (BioTek) before incubation with a PE conjugated mouse anti-human IgG Fc secondary antibody (Southern Biotech). Beads were classified and binding of PE was measured using a FLEXMAP 3D flow cytometer (Luminex).

RSV Neutralization Assays

Viral stocks were prepared and maintained as previously described (61). Recombinant mKate-RSV expressing prototypic subtype A (strain A2) and subtype B (18537) F genes and the Katushka fluorescent protein were constructed as reported by Hotard et al. (62). HEp-2 cells were maintained in Eagle's minimal essential medium containing 10% fetal bovine serum supplemented with glutamine, penicillin and streptomycin. Antibody neutralization was measured by a fluorescence plate reader neutralization assay (15). A 30 μL solution of culture media containing $2.4\times10^4$ HEp-2 cells was seeded in 384-well black optical bottom plate (Nunc, Thermo Scientific). IgG samples were serially diluted four-fold from 1:10 to 1:163840 and an equal volume of recombinant mKate-RSV A2 was added. Samples were mixed and incubated at 37° C. for one hour. After incubation, 50 μL mixture of sample and virus was added to cells in 384-well plate, and incubated at 37° C. for 22-24 hours. The assay plate was then measured for fluorescence intensity in a microplate reader at Ex 588 nm and Em 635 nm (SpectraMax Paradigm, molecular devices). $IC_{50}$ of neutralization for each sample was calculated by curve fitting using Prism (GraphPad Software Inc.).

Human Metapneuomovirus Neutralization Assays

Predetermined amounts of GFP-expressing hMPV recombinant virus (NL/1/00, A1 sublineage, a kind gift of Bernadette van den Hoogen and Ron Fouchier, Rotterdam, the Netherlands) were mixed with serial dilutions of monoclonal antibodies before being added to cultures of Vero-118 cells growing in 96-well plates with Dulbecco's Modified Eagle's medium supplemented with 10% fetal calf serum. Thirty-six hours later, the medium was removed, PBS was added and the amount of GFP per well was measured with a Tecan microplate reader M200. Fluorescence values were represented as percent of a virus control without antibody.

Polyreactivity Assay

Antibody polyreactivity was assessed using a previously described high-throughput assay that measures binding to solubilized CHO cell membrane preparations (SMPs) (43). Briefly, two million IgG-presenting yeast were transferred into a 96-well assay plate and pelleted to remove the supernatant. The pellet was resuspended in 50 μL of 1:10 diluted stock b-SMPs and incubated on ice for 20 minutes. Cells were then washed twice with ice-cold PBSF and the cell pellet was re-suspended in 50 µL of secondary labeling mix (Extravidin-R-PE, anti-human LCFITC, and propidium iodide). The mix was incubated on ice for 20 minutes followed by two washes with ice-cold PBSF. Cells were then re-suspended in 100 µL of ice-cold PBSF, and the plate was run on a FACSCanto II (BD Biosciences) using a HTS sample injector. Flow cytometry data was analyzed for mean fluorescence intensity in the R-PE channel and normalized to proper controls in order to assess non-specific binding.

REFERENCES AND NOTES

1. A. L. Rogovik, B. Carleton, A. Solimano, R. D. Goldman, Palivizumab for the prevention of respiratory syncytial virus infection. *Can Fam Physician* 56, 769-772 (2010).
2. B. S. Graham, Biological challenges and technological opportunities for respiratory syncytial virus vaccine development. *Immunol Rev* 239, 149-166 (2011).
3. J. R. Groothuis, E. A. Simoes, V. G. Hemming, Respiratory syncytial virus (RSV) infection in preterm infants and the protective effects of RSV immune globulin (RSVIG). Respiratory Syncytial Virus Immune Globulin Study Group. *Pediatrics* 95, 463-467 (1995).
4. M. Magro, V. Mas, K. Chappell, M. Vazquez, O. Cano, D. Luque, M. C. Terron, J. A. Melero, C. Palomo, Neutralizing antibodies against the preactive form of respiratory syncytial virus fusion protein offer unique possibilities for clinical intervention. *Proc Natl Acad Sci USA* 109, 3089-3094 (2012).
5. S. Johnson, C. Oliver, G. A. Prince, V. G. Hemming, D. S. Pfarr, S. C. Wang, M. Dormitzer, J. O'Grady, S. Koenig, J. K. Tamura, R. Woods, G. Bansal, D. Couchenour, E. Tsao, W. C. Hall, J. F. Young, Development of a humanized monoclonal antibody (MEDI-493) with potent in vitro and in vivo activity against respiratory syncytial virus. *J Infect Dis* 176, 1215-1224 (1997).
6. J. A. Beeler, K. van Wyke Coelingh, Neutralization epitopes of the F glycoprotein of respiratory syncytial virus: effect of mutation upon fusion function. *J Virol* 63, 2941-2950 (1989).
7. R. A. Karron, D. A. Buonagurio, A. F. Georgiu, S. S. Whitehead, J. E. Adamus, M. L. Clements-Mann, D. O. Harris, V. B. Randolph, S. A. Udem, B. R. Murphy, M. S. Sidhu, Respiratory syncytial virus (RSV) SH and G proteins are not essential for viral replication in vitro: clinical evaluation and molecular characterization of a cold-passaged, attenuated RSV subgroup B mutant. *Proc Natl Acad Sci USA* 94, 13961-13966 (1997).
8. J. O. Ngwuta, M. Chen, K. Modjarrad, M. G. Joyce, M. Kanekiyo, A. Kumar, H. M. Yassine, S. M. Moin, A. M. Killikelly, G. Y. Chuang, A. Druz, I. S. Georgiev, E. J. Rundlet, M. Sastry, G. B. Stewart-Jones, Y. Yang, B. Zhang, M. C. Nason, C. Capella, M. E. Peeples, J. E. Ledgerwood, J. S. McLellan, P. D. Kwong, B. S. Graham, Prefusion F-specific antibodies determine the magnitude of RSV neutralizing activity in human sera. *Sci Transl Med* 7, 309ra162 (2015).
9. T. I.-R. S. Group, Palivizumab, a humanized respiratory syncytial virus monoclonal antibody, reduces hospitalization from respiratory syncytial virus infection in high-risk infants. *Pediatrics* 102, 531-537 (1998).
10. J. S. McLellan, M. Chen, S. Leung, K. W. Graepel, X. Du, Y. Yang, T. Zhou, U. Baxa, E. Yasuda, T. Beaumont, A. Kumar, K. Modjarrad, Z. Zheng, M. Zhao, N. Xia, P. D. Kwong, B. S. Graham, Structure of RSV fusion glycoprotein trimer bound to a prefusion-specific neutralizing antibody. *Science* 340, 1113-1117 (2013).
11. J. S. McLellan, Y. Yang, B. S. Graham, P. D. Kwong, Structure of respiratory syncytial virus fusion glycoprotein in the postfusion conformation reveals preservation of neutralizing epitopes. *J Virol* 85, 7788-7796 (2011).
12. K. A. Swanson, E. C. Settembre, C. A. Shaw, A. K. Dey, R. Rappuoli, C. W. Mandl, P. R. Dormitzer, A. Carfi, Structural basis for immunization with postfusion respiratory syncytial virus fusion F glycoprotein (RSV F) to elicit high neutralizing antibody titers. *Proc Natl Acad Sci USA* 108, 9619-9624 (2011).
13. L. Liljeroos, M. A. Krzyzaniak, A. Helenius, S. J. Butcher, Architecture of respiratory syncytial virus revealed by electron cryotomography. *Proc Natl Acad Sci USA* 110, 11133-11138 (2013).
14. A. Krarup, D. Truan, P. Furmanova-Hollenstein, L. Bogaert, P. Bouchier, I. J. Bisschop, M. N. Widjojoatmodjo, R. Zahn, H. Schuitemaker, J. S. McLellan, J. P. Langedijk, A highly stable prefusion RSV F vaccine derived from structural analysis of the fusion mechanism. *Nat Commun* 6, 8143 (2015).
15. J. S. McLellan, M. Chen, M. G. Joyce, M. Sastry, G. B. Stewart-Jones, Y. Yang, B. Zhang, L. Chen, S. Srivatsan, A. Zheng, T. Zhou, K. W. Graepel, A. Kumar, S. Moin, J. C. Boyington, G. Y. Chuang, C. Soto, U. Baxa, A. Q. Bakker, H. Spits, T. Beaumont, Z. Zheng, N. Xia, S. Y. Ko, J. P. Todd, S. Rao, B. S. Graham, P. D. Kwong, Structure-based design of a fusion glycoprotein vaccine for respiratory syncytial virus. *Science* 342, 592-598 (2013).
16. M. J. Kwakkenbos, S. A. Diehl, E. Yasuda, A. Q. Bakker, C. M. van Geelen, M. V. Lukens, G. M. van Bleek, M. N. Widjojoatmodjo, W. M. Bogers, H. Mei, A. Radbruch, F. A. Scheeren, H. Spits, T. Beaumont, Generation of stable monoclonal antibody-producing B cell receptor-positive human memory B cells by genetic programming. *Nat Med* 16, 123-128 (2010).
17. D. Corti, S. Bianchi, F. Vanzetta, A. Minola, L. Perez, G. Agatic, B. Guarino, C. Silacci, J. Marcandalli, B. J. Marsland, A. Piralla, E. Percivalle, F. Sallusto, F. Baldanti, A. Lanzavecchia, Cross-neutralization of four paramyxoviruses by a human monoclonal antibody. *Nature* 501, 439-443 (2013).
18. M. Magro, D. Andreu, P. Gomez-Puertas, J. A. Melero, C. Palomo, Neutralization of human respiratory syncytial virus infectivity by antibodies and low-molecular-weight compounds targeted against the fusion glycoprotein. *J Virol* 84, 7970-7982 (2010).
19. G. Taylor, E. J. Stott, J. Furze, J. Ford, P. Sopp, Protective epitopes on the fusion protein of respiratory syncytial virus recognized by murine and bovine monoclonal antibodies. *J Gen Virol* 73 (Pt 9), 2217-2223 (1992).
20. L. J. Calder, L. Gonzalez-Reyes, B. Garcia-Barreno, S. A. Wharton, J. J. Skehel, D. C. Wiley, J. A. Melero, Electron microscopy of the human respiratory syncytial virus fusion protein and complexes that it forms with monoclonal antibodies. *Virology* 271, 122-131 (2000).
21. M. S. Gilman, S. M. Moin, V. Mas, M. Chen, N. K. Patel, K. Kramer, Q. Zhu, S. C. Kabeche, A. Kumar, C. Palomo, T. Beaumont, U. Baxa, N. D. Ulbrandt, J. A. Melero, B. S. Graham, J. S. McLellan, Characterization of a Prefusion-Specific Antibody That Recognizes a Quaternary, Cleavage-Dependent Epitope on the RSV Fusion Glycoprotein. *PLoS Pathog* 11, e1005035 (2015).
22. M. G. Joyce, A. K. Wheatley, P. V. Thomas, G. Y. Chuang, C. Soto, R. T. Bailer, A. Druz, I. S. Georgiev, R. A. Gillespie, M. Kanekiyo, W. P. Kong, K. Leung, S. N.

Narpala, M. S. Prabhakaran, E. S. Yang, B. Zhang, Y. Zhang, M. Asokan, J. C. Boyington, T. Bylund, S. Darko, C. R. Lees, A. Ransier, C. H. Shen, L. Wang, J. R. Whittle, X. Wu, H. M. Yassine, C. Santos, Y. Matsuoka, T. Tsybovsky, U. Baxa, J. C. Mullikin, K. Subbarao, D. C. Douek, B. S. Graham, R. A. Koup, J. E. Ledgerwood, M. Roederer, L. Shapiro, P. D. Kwong, J. R. Mascola, A. B. McDermott, Vaccine-Induced Antibodies that Neutralize Group 1 and Group 2 Influenza A Viruses. *Cell* 166, 609-623 (2016).
23. J. Truck, M. N. Ramasamy, J. D. Galson, R. Rance, J. Parkhill, G. Lunter, A. J. Pollard, D. F. Kelly, Identification of antigen-specific B cell receptor sequences using public repertoire analysis. *J Immunol* 194, 252-261 (2015).
24. P. Parameswaran, Y. Liu, K. M. Roskin, K. K. Jackson, V. P. Dixit, J. Y. Lee, K. L. Artiles, S. Zompi, M. J. Vargas, B. B. Simen, B. Hanczaruk, K. R. McGowan, M. A. Tariq, N. Pourmand, D. Koller, A. Balmaseda, S. D. Boyd, E. Harris, A. Z. Fire, Convergent antibody signatures in human dengue. *Cell host & microbe* 13, 691-700 (2013).
25. K. J. Jackson, Y. Liu, K. M. Roskin, J. Glanville, R. A. Hoh, K. Seo, E. L. Marshall, T. C. Gurley, M. A. Moody, B. F. Haynes, E. B. Walter, H. X. Liao, R. A. Albrecht, A. Garcia-Sastre, J. Chaparro-Riggers, A. Rajpal, J. Pons, B. B. Simen, B. Hanczaruk, C. L. Dekker, J. Laserson, D. Koller, M. M. Davis, A. Z. Fire, S. D. Boyd, Human responses to influenza vaccination show seroconversion signatures and convergent antibody rearrangements. *Cell host & microbe* 16, 105-114 (2014).
26. F. W. Henderson, A. M. Collier, W. A. Clyde, Jr., F. W. Denny, Respiratory-syncytial-virus infections, reinfections and immunity. A prospective, longitudinal study in young children. *The New England journal of medicine* 300, 530-534 (1979).
27. M. A. Moody, B. F. Haynes, Antigen-specific B cell detection reagents: use and quality control. *Cytometry A* 73, 1086-1092 (2008).
28. M. S. Habibi, A. Jozwik, S. Makris, J. Dunning, A. Paras, J. P. DeVincenzo, C. A. de Haan, J. Wrammert, P. J. Openshaw, C. Chiu, I. Mechanisms of Severe Acute Influenza Consortium, Impaired Antibody-mediated Protection and Defective IgA B-Cell Memory in Experimental Infection of Adults with Respiratory Syncytial Virus. *Am J Respir Crit Care Med* 191, 1040-1049 (2015).
29. T. Tiller, E. Meffre, S. Yurasov, M. Tsuiji, M. C. Nussenzweig, H. Wardemann, Efficient generation of monoclonal antibodies from single human B cells by single cell RT-PCR and expression vector cloning. *J Immunol Methods* 329, 112-124 (2008).
30. Z. A. Bornholdt, H. L. Turner, C. D. Murin, W. Li, D. Sok, C. A. Souders, A. E. Piper, A. Goff, J. D. Shamblin, S. E. Wollen, T. R. Sprague, M. L. Fusco, K. B. Pommert, L. A. Cavacini, H. L. Smith, M. Klempner, K. A. Reimann, E. Krauland, T. U. Gerngross, K. D. Wittrup, E. O. Saphire, D. R. Burton, P. J. Glass, A. B. Ward, L. M. Walker, Isolation of potent neutralizing antibodies from a survivor of the 2014 Ebola virus outbreak. *Science* 351, 1078-1083 (2016).
31. J. F. Scheid, H. Mouquet, N. Feldhahn, M. S. Seaman, K. Velinzon, J. Pietzsch, R. G. Ott, R. M. Anthony, H. Zebroski, A. Hurley, A. Phogat, B. Chakrabarti, Y. Li, M. Connors, F. Pereyra, B. D. Walker, H. Wardemann, D. Ho, R. T. Wyatt, J. R. Mascola, J. V. Ravetch, M. C. Nussenzweig, Broad diversity of neutralizing antibodies isolated from memory B cells in HIV-infected individuals. *Nature* 458, 636-640 (2009).
32. J. Wrammert, K. Smith, J. Miller, W. A. Langley, K. Kokko, C. Larsen, N. Y. Zheng, I. Mays, L. Garman, C. Helms, J. James, G. M. Air, J. D. Capra, R. Ahmed, P. C. Wilson, Rapid cloning of high-affinity human monoclonal antibodies against influenza virus. *Nature* 453, 667-671 (2008).
33. S. D. Boyd, B. A. Gaeta, K. J. Jackson, A. Z. Fire, E. L. Marshall, J. D. Merker, J. M. Maniar, L. N. Zhang, B. Sahaf, C. D. Jones, B. B. Simen, B. Hanczaruk, K. D. Nguyen, K. C. Nadeau, M. Egholm, D. B. Miklos, J. L. Zehnder, A. M. Collins, Individual variation in the germline Ig gene repertoire inferred from variable region gene rearrangements. *J Immunol* 184, 6986-6992 (2010).
34. J. Sui, W. C. Hwang, S. Perez, G. Wei, D. Aird, L. M. Chen, E. Santelli, B. Stec, G. Cadwell, M. Ali, H. Wan, A. Murakami, A. Yammanuru, T. Han, N. J. Cox, L. A. Bankston, R. O. Donis, R. C. Liddington, W. A. Marasco, Structural and functional bases for broad-spectrum neutralization of avian and human influenza A viruses. *Nat Struct Mol Biol* 16, 265-273 (2009).
35. C. C. Huang, M. Venturi, S. Majeed, M. J. Moore, S. Phogat, M. Y. Zhang, D. S. Dimitrov, W. A. Hendrickson, J. Robinson, J. Sodroski, R. Wyatt, H. Choe, M. Farzan, P. D. Kwong, Structural basis of tyrosine sulfation and VH-gene usage in antibodies that recognize the HIV type 1 coreceptor-binding site on gp120. *Proc Natl Acad Sci USA* 101, 2706-2711 (2004).
36. C. H. Chan, K. G. Hadlock, S. K. Foung, S. Levy, V(H)1-69 gene is preferentially used by hepatitis C virus-associated B cell lymphomas and by normal B cells responding to the E2 viral antigen. *Blood* 97, 1023-1026 (2001).
37. E. E. Godoy-Lozano, J. Tellez-Sosa, G. Sanchez-Gonzalez, H. Samano-Sanchez, A. Aguilar-Salgado, A. Salinas-Rodriguez, B. Cortina-Ceballos, H. Vivanco-Cid, K. Hernandez-Flores, J. M. Pfaff, K. M. Kahle, B. J. Doranz, R. E. Gomez-Barreto, H. Valdovinos-Torres, I. Lopez-Martinez, M. H. Rodriguez, J. Martinez-Barnetche, Lower IgG somatic hypermutation rates during acute dengue virus infection is compatible with a germinal center-independent B cell response. *Genome Med* 8, 23 (2016).
38. J. Wrammert, D. Koutsonanos, G. M. Li, S. Edupuganti, J. Sui, M. Morrissey, M. McCausland, I. Skountzou, M. Hornig, W. I. Lipkin, A. Mehta, B. Razavi, C. Del Rio, N. Y. Zheng, J. H. Lee, M. Huang, Z. Ali, K. Kaur, S. Andrews, R. R. Amara, Y. Wang, S. R. Das, C. D. O'Donnell, J. W. Yewdell, K. Subbarao, W. A. Marasco, M. J. Mulligan, R. Compans, R. Ahmed, P. C. Wilson, Broadly cross-reactive antibodies dominate the human B cell response against 2009 pandemic H1N1 influenza virus infection. *J Exp Med* 208, 181-193 (2011).
39. S. F. Andrews, Y. Huang, K. Kaur, L. I. Popova, I. Y. Ho, N. T. Pauli, C. J. Henry Dunand, W. M. Taylor, S. Lim, M. Huang, X. Qu, J. H. Lee, M. Salgado-Ferrer, F. Krammer, P. Palese, J. Wrammert, R. Ahmed, P. C. Wilson, Immune history profoundly affects broadly protective B cell responses to influenza. *Sci Transl Med* 7, 316ra192 (2015).
40. M. Liu, G. Yang, K. Wiehe, N. I. Nicely, N. A. Vandergrift, W. Rountree, M. Bonsignori, S. M. Alam, J. Gao, B. F. Haynes, G. Kelsoe, Polyreactivity and autoreactivity among HIV-1 antibodies. *J Virol* 89, 784-798 (2015).
41. H. Mouquet, J. F. Scheid, M. J. Zoller, M. Krogsgaard, R. G. Ott, S. Shukair, M. N. Artyomov, J. Pietzsch, M. Connors, F. Pereyra, B. D. Walker, D. D. Ho, P. C. Wilson, M. S. Seaman, H. N. Eisen, A. K. Chakraborty, T. J. Hope, 41. J. V. Ravetch, H. Wardemann, M. C. Nussenzweig, Polyreactivity increases the apparent affinity of anti-HIV antibodies by heteroligation. *Nature* 467, 591-595 (2010).
42. R. L. Kelly, T. Sun, T. Jain, I. Caffry, Y. Yu, Y. Cao, H. Lynaugh, M. Brown, M. Vasquez, K. D. Wittrup, Y. Xu, High throughput cross-interaction measures for human IgG1 antibodies correlate with clearance rates in mice. *MAbs*, 0 (2015).
43. Y. Xu, W. Roach, T. Sun, T. Jain, B. Prinz, T. Y. Yu, J. Torrey, J. Thomas, P. Bobrowicz, M. Vasquez, K. D. Wittrup, E. Krauland, Addressing polyspecificity of antibodies selected from an in vitro yeast presentation system: a FACS-based, high-throughput selection and analytical tool. *Protein Eng Des Sel* 26, 663-670 (2013).
44. D. R. Bowley, A. F. Labrijn, M. B. Zwick, D. R. Burton, Antigen selection from an HIV-1 immune antibody library displayed on yeast yields many novel antibodies compared to selection from the same library displayed on phage. *Protein Eng Des Sel* 20, 81-90 (2007).
45. H. Wu, D. S. Pfarr, S. Johnson, Y. A. Brewah, R. M. Woods, N. K. Patel, W. I. White, J. F. Young, P. A. Kiener, Development of motavizumab, an ultra-potent antibody for the prevention of respiratory syncytial virus infection in the upper and lower respiratory tract. *Journal of molecular biology* 368, 652-665 (2007).
46. J. S. McLellan, M. Chen, J. S. Chang, Y. Yang, A. Kim, B. S. Graham, P. D. Kwong, Structure of a major antigenic site on the respiratory syncytial virus fusion glycoprotein in complex with neutralizing antibody 101F. *J Virol* 84, 12236-12244 (2010).
47. P. W. Parren, D. R. Burton, The antiviral activity of antibodies in vitro and in vivo. *Advances in immunology* 77, 195-262 (2001).
48. J. Foote, H. N. Eisen, Kinetic and affinity limits on antibodies produced during immune responses. *Proc Natl Acad Sci USA* 92, 1254-1256 (1995).
49. F. D. Batista, M. S. Neuberger, Affinity dependence of the B cell response to antigen: a threshold, a ceiling, and the importance of off-rate. *Immunity* 8, 751-759 (1998).
50. J. E. Schuster, R. G. Cox, A. K. Hastings, K. L. Boyd, J. Wadia, Z. Chen, D. R. Burton, R. A. Williamson, J. V. Williams, A broadly neutralizing human monoclonal antibody exhibits in vivo efficacy against both human metapneumovirus and respiratory syncytial virus. *J Infect Dis* 211, 216-225 (2015).
51. B. F. Fernie, P. J. Cote, Jr., J. L. Gerin, Classification of hybridomas to respiratory syncytial virus glycoproteins. Proceedings of the Society for Experimental Biology and Medicine. Society for Experimental Biology and Medicine (New York, N.Y.) 171, 266-271 (1982).
52. P. J. Cote, Jr., B. F. Fernie, E. C. Ford, J. W. Shih, J. L. Gerin, Monoclonal antibodies to respiratory syncytial virus: detection of virus neutralization and other antigen-antibody systems using infected human and murine cells. *Journal of virological methods* 3, 137-147 (1981).
53. E. E. Walsh, J. Hruska, Monoclonal antibodies to respiratory syncytial virus proteins: identification of the fusion protein. *J Virol* 47, 171-177 (1983).
54. L. J. Anderson, P. Bingham, J. C. Hierholzer, Neutralization of respiratory syncytial virus by individual and mixtures of F and G protein monoclonal antibodies. *J Virol* 62, 4232-4238 (1988).
55. G. E. Scopes, P. J. Watt, P. R. Lambden, Identification of a linear epitope on the fusion glycoprotein of respiratory syncytial virus. *J Gen Virol* 71 (Pt 1), 53-59 (1990).
56. J. Arbiza, G. Taylor, J. A. Lopez, J. Furze, S. Wyld, P. Whyte, E. J. Stott, G. Wertz, W. Sullender, M. Trudel, et al., Characterization of two antigenic sites recognized by neutralizing monoclonal antibodies directed against the fusion glycoprotein of human respiratory syncytial virus. *J Gen Virol* 73 (Pt 9), 2225-2234 (1992).
57. J. A. Lopez, R. Bustos, C. Orvell, M. Berois, J. Arbiza, B. Garcia-Barreno, J. A. Melero, Antigenic structure of human respiratory syncytial virus fusion glycoprotein. *J Virol* 72, 6922-6928 (1998).
58. B. J. DeKosky, T. Kojima, A. Rodin, W. Charab, G. C. Ippolito, A. D. Ellington, G. Georgiou, In-depth determination and analysis of the human paired heavy- and light-chain antibody repertoire. *Nat Med* 21, 86-91 (2015).
59. U.S. National Library of Medicine, (NCT02290340, https://clinicaltrials.gov/).
60. PATH, *RSV Vaccine Snapshot* (2016 http://sites.path.org/vaccinedevelopment/files/2016/07/RSV-snapshot-July_13_2016.pdf).
61. B. S. Graham, M. D. Perkins, P. F. Wright, D. T. Karzon, Primary respiratory syncytial virus infection in mice. *Journal of medical virology* 26, 153-162 (1988).
62. A. L. Hotard, F. Y. Shaikh, S. Lee, D. Yan, M. N. Teng, R. K. Plemper, J. E. Crowe, Jr., M. L. Moore, A stabilized respiratory syncytial virus reverse genetics system amenable to recombination-mediated mutagenesis. *Virology* 434, 129-136 (2012).

An informal sequence listing is provided in Table 6, below. The informal sequence listing provides the following sixteen (16) sequence elements contained in each of the 133 antibodies, identified as described above and designated as Antibody Numbers (Ab #) 232 through 364, in the following order:

- Heavy chain variable region ("HC") nucleic acid sequence
- Heavy chain variable region ("HC") amino acid sequence
- Heavy chain variable region CDR H1 ("H1") amino acid sequence
- Heavy chain variable region CDR H1 ("H1") nucleic acid sequence
- Heavy chain variable region CDR H2 ("H2") amino acid sequence
- Heavy chain variable region CDR H2 ("H2") nucleic acid sequence
- Heavy chain variable region CDR H3 ("H3") amino acid sequence
- Heavy chain variable region CDR H3 ("H3") nucleic acid sequence
- Light chain variable region ("LC") nucleic acid sequence
- Light chain variable region ("LC") amino acid sequence
- Light chain variable region CDR L1 ("L1") amino acid sequence
- Light chain variable region CDR L1 ("L1") nucleic acid sequence
- Light chain variable region CDR L2 ("L2") amino acid sequence
- Light chain variable region CDR L2 ("L2") nucleic acid sequence
- Light chain variable region CDR L3 ("L3") amino acid sequence
- Light chain variable region CDR L3 ("L3") nucleic acid sequence The informal sequence listing for antibodies 365-372 provides the following ten (10) sequence elements contained in each of the 8 antibodies, identified as described above and designated as Antibody Numbers (Ab #) 365 through 372, in the following order:

Heavy chain variable region ("HC") nucleic acid sequence
Heavy chain variable region ("HC") amino acid sequence
Heavy chain variable region CDR H1 ("H1") amino acid sequence
Heavy chain variable region CDR H2 ("H2") amino acid sequence
Heavy chain variable region CDR H3 ("H3") amino acid sequence Light chain variable region ("LC") nucleic acid sequence
Light chain variable region ("LC") amino acid sequence
Light chain variable region CDR L1 ("L1") amino acid sequence
Light chain variable region CDR L2 ("L2") amino acid sequence
Light chain variable region CDR L3 ("L3") amino acid sequence

TABLE 6

Informal Sequence Listing

| Antibody No. | Seq. Ref. No. | SEQ ID NO. | Sequence |
|---|---|---|---|
| 232 | 3697 | 1 | CAGGTGCAGCTACAGCAGTGGGGCGCAGGACTGTTGAAGCCTTCGGAGACCCTGTCCCTCACCTGCGCTGTCTATGGTGGGTCCTTCAGTGGTTATTCCTGGAGCTGGATCCGCCAGACCCCAGGGAAGGGGCTGGAGTGGATTGGGGAAATCAATCATAGAGGAAGCACCAACTACAACCCGTCCCTCAAGAGTCGAGTCACCATGTCAGTGGACACGTCCCAGAACCAGATCTCCCTGAGGGTGACCTCTGTGACCGCCGCGGACACGGCTGTATATTTCTGTGCGGGGACCAATTATGGAGAGGTTAATACGAGTAACCAGTACTTCTTCGGTATGGACGTCTGGGGCCAAGGGACCACGGTCACCGTCTCCTCA |
| 232 | 3698 | 2 | QVQLQQWGAGLLKPSETLSLTCAVYGGSFSGYSWSWIRQTPGKGLEWIGEINHRGSTNYNPSLKSRVTMSVDTSQNQISLRVTSVTAADTAVYFCAGTNYGEVNTSNQYFFGMDVWGQGTTVTVSS |
| 232 | 3699 | 3 | GSFSGYSWS |
| 232 | 3700 | 4 | GGGTCCTTCAGTGGTTATTCCTGGAGC |
| 232 | 3701 | 5 | EINHRGSTNYNPSLKS |
| 232 | 3702 | 6 | GAAATCAATCATAGAGGAAGCACCAACTACAACCCGTCCCTCAAGAGT |
| 232 | 3703 | 7 | AGTNYGEVNTSNQYFFGMDV |
| 232 | 3704 | 8 | GCGGGGACCAATTATGGAGAGGTTAATACGAGTAACCAGTACTTCTTCGGTATGGACGTC |
| 232 | 3705 | 9 | GACATCCAGGTGACCCAGTCTCCATCCTCCCTGTCTGCATCTGTAGGAGACAGAGTCACCATCACTTGCCGGGCAAGTCAGAGCATTGGCACCTATTTAAATTGGTATCAGCAGAAACCAGGGAAACCCCCTAAACTCCTGATCTATGCTGCATCCAATTTGGAAAGTGGGGTCCCATCAAGTTTCAGTGGCAGTGGATCTGGGACACATTTCACTCTCACCATCAGCAGTCTGCAACCTGAACATTTTGCAACTTACTACTGTCAACAGAGTTACAGTACCCCGCTCACTTTCGGCGGAGGGACCAAGGTGGAAATCAAA |
| 232 | 3706 | 10 | DIQVTQSPSSLSASVGDRVTITCRASQSIGTYLNWYQQKPGKPPKLLIYAASNLESGVPSSFSGSGSGTHFTLTISSLQPEHFATYYCQQSYSTPLTFGGGTKVEIK |
| 232 | 3707 | 11 | RASQSIGTYLN |
| 232 | 3708 | 12 | CGGGCAAGTCAGAGCATTGGCACCTATTTAAAT |
| 232 | 3709 | 13 | AASNLES |
| 232 | 3710 | 14 | GCTGCATCCAATTTGGAAAGT |
| 232 | 3711 | 15 | QQSYSTPLT |
| 232 | 3712 | 16 | CAACAGAGTTACAGTACCCCGCTCACT |
| 233 | 3713 | 17 | CAGGTGCAGCTGCAGGAGTCGGGCCCAGGACTGGTGAAGCCTTCACAGACCCTGTCCCTCACCTGCACTGTCTCTGGTCCCTCCATCAGCAGTGGTGATTACTACTGGACTTGGATCCGCCAGCCCCCAGGGAAGGGCCTGGAGTGGATTGGCTACATCTATAACAGTGGGAGCACCGACTACAACCCGTCCCTCAAGAGTCGTATCACCATGTCACTAGACAG |

TABLE 6-continued

Informal Sequence Listing

| Antibody No. | Seq. Ref. No. | SEQ ID NO. | Sequence |
|---|---|---|---|
| | | | GTCCAAGAACCAGTTCTCCCTGAATCTGAGCTCTGTG ACTGCCGCAGACACGGCCGTGTATTTCTGTGCCAGGG ATGTGGGTACTCTGGTACTACCAACTGTTGCTTACTAC TACGGCATGGACGTCTGGGGCCAAGGGACCACGGTCA CCGTCTCCTCA |
| 233 | 3714 | 18 | QVQLQESGPGLVKPSQTLSLTCTVSGPSISSGDYYWTWI RQPPGKGLEWIGYIYNSGSTDYNPSLKSRITMSLDRSKN QFSLNLSSVTAADTAVYFCARDVGTLVLPTVAYYYGMD VWGQGTTVTVSS |
| 233 | 3715 | 19 | PSISSGDYYWT |
| 233 | 3716 | 20 | CCCTCCATCAGCAGTGGTGATTACTACTGGACT |
| 233 | 3717 | 21 | YIYNSGSTDYNPSLKS |
| 233 | 3718 | 22 | TACATCTATAACAGTGGGAGCACCGACTACAACCCGT CCCTCAAGAGT |
| 233 | 3719 | 23 | ARDVGTLVLPTVAYYYGMDV |
| 233 | 3720 | 24 | GCCAGGGATGTGGGTACTCTGGTACTACCAACTGTTG CTTACTACTACGGCATGGACGTC |
| 233 | 3721 | 25 | GAAATTGTATTGACGCAGTCTCCAGGCACCCTGTCTTT GTCTCCGGGGGAAAGAGCCACCCTCTCCTGCAGGGCC AGTGAGAGTATTAGCAGCAGCTACTTAGCCTGGTACC AGCAGAAACCTGGCCAGGCTCCCAGACTCCTCATCTA TGATGCGTCCAGCAGGGCCACTGGCATCCCAGACAGG TTCAGTGGCAGTGGGTCTGGGACAGACTTCACTCTCA CCATCAGCAGTCTGGAGCCTGAAGATTTTGCAGTGTA TTACTGTCAGCAGTATGGTAGCTCACCCCTGGTCACTT TCGGCCCTGGGACCAAAGTGGATATCAAA |
| 233 | 3722 | 26 | EIVLTQSPGTLSLSPGERATLSCRASESISSSYLAWYQQKP GQAPRLLIYDASSRATGIPDRFSGSGSGTDFTLTISSLEPE DFAVYYCQQYGSSPLVTFGPGTKVDIK |
| 233 | 3723 | 27 | RASESISSSYLA |
| 233 | 3724 | 28 | AGGGCCAGTGAGAGTATTAGCAGCAGCTACTTAGCC |
| 233 | 3725 | 29 | DASSRAT |
| 233 | 3726 | 30 | GATGCGTCCAGCAGGGCCACT |
| 233 | 3727 | 31 | QQYGSSPLVT |
| 233 | 3728 | 32 | CAGCAGTATGGTAGCTCACCCCTGGTCACT |
| 234 | 3729 | 33 | CAGGTTCCAGCTGGTGCAGTCTGGAACTGAGGTGAAGA AGCCTGGGGCCTCAGTGAAGGTCTCCTGTAAGGCTGC TGGTTACACCTTTAGCAACTACGGTGTCAGTTGGGTGC GACAGGCCCCTGGACAGGGGCTTGAGTGGATGGGATG GATCAGCGCTTATAATGGTAACACAAAATTTGCACAG AAGGTCCAGGGCAGACTCACCATGACCACAGACACAT CTACCAGCACAGCCTACATGGAATTGAGGAACCTCAG ATCTGACGACACGGCCGTGTATTATTGTGCGAGAGAA TCAGGGGCAACAGCGGCTGCTATGTTTGACTACTGGG GCCAGGGAACCCTGGTCACCGTCTCCTCA |
| 234 | 3730 | 34 | QVQLVQSGTEVKKPGASVKVSCKAAGYTFSNYGVSWV RQAPGQGLEWMGWISAYNGNTKFAQKVQGRLTMTTDT STSTAYMELRNLRSDDTAVYYCARESGATAAAMFDYW GQGTLVTVSS |
| 234 | 3731 | 35 | YTFSNYGVS |
| 234 | 3732 | 36 | TACACCTTTAGCAACTACGGTGTCAGT |
| 234 | 3733 | 37 | WISAYNGNTKFAQKVQG |
| 234 | 3734 | 38 | TGGATCAGCGCTTATAATGGTAACACAAAATTTGCAC AGAAGGTCCAGGGC |

TABLE 6-continued

Informal Sequence Listing

| Antibody No. | Seq. Ref. No. | SEQ ID NO. | Sequence |
|---|---|---|---|
| 234 | 3735 | 39 | ARESGATAAAMFDY |
| 234 | 3736 | 40 | GCGAGAGAATCAGGGGCAACAGCGGCTGCTATGTTTG ACTAC |
| 234 | 3737 | 41 | GAAACGACACTCACGCAGTCTCCACTCTCCCTGCCCG TCACCCTTGGACAGCCGGCCTCCATCTCCTGCAGGTCT AGTCAAAGCCTCGAATACAGTGATGGAAACATCTACT TGAGTTGGTTTCAACAGAGGCCAGGCCAATCTCCAAG GCGCCTAATTTATAAGGTTTCTCACCGGGACTCTGGG GTCCCAGACAGATTCAGCGGCAGTGGGTCAGGCACTG ATTTCACACTGAAAATCGCCAGGGTGGAGGCTGAGGA TGTTGCAGTTTATTACTGCATGCAAGCTATACACTGGC CTCGAACTTTTGGCCAGGGGACCAAAGTGGATATCAA A |
| 234 | 3738 | 42 | ETTLTQSPLSLPVTLGQPASISCRSSQSLEYSDGNIYLSWF QQRPGQSPRRLIYKVSHRDSGVPDRFSGSGSGTDFTLKIA RVEAEDVAVYYCMQAIHWPRTFGQGTKVDIK |
| 234 | 3739 | 43 | RSSQSLEYSDGNIYLS |
| 234 | 3740 | 44 | AGGTCTAGTCAAAGCCTCGAATACAGTGATGGAAACA TCTACTTGAGT |
| 234 | 3741 | 45 | KVSHRDS |
| 234 | 3742 | 46 | AAGGTTTCTCACCGGGACTCT |
| 234 | 3743 | 47 | MQAIHWPRT |
| 234 | 3744 | 48 | ATGCAAGCTATACACTGGCCTCGAACT |
| 235 | 3745 | 49 | CAGGTGCAGCTGCAGGAGTCGGGCCCAAGACTGGTGA AGCCTTCACAGACCCTGTCCCTCATCTGCGATGTCTCT GGTGGCTCCATCGGCAGTGGTGACCACTACTGGAGTT GGATCCGCCAGCCCCCCGGGAAGGGCCTGAGTGGAT TGGGTACATCTATTACAGTGGGACCACTTACTACAAC CCGTCCCTCAAGAGTCGAGTGACCATTTCAGCAGACA CGTCCAAGAACCAGTTGTCCCTGAAATTGAGTTCTGT GACTGCCGCAGACACGGCCATTTATTTCTGTGCCAGA GATGGGGGTTATGATCACGTCTGGGGGACTCATCGTT ATTTCGACAAGTGGGGCCAGGGAACCCTGGTCACCGT CTCCTCA |
| 235 | 3746 | 50 | QVQLQESGPRLVKPSQTLSLICDVSGGSIGSGDHYWSWI RQPPGKGLEWIGYIYYSGTTYYNPSLKSRVTISADTSKN QLSLKLSSVTAADTAIYFCARDGGYDHVWGTHRYFDK WGQGTLVTVSS |
| 235 | 3747 | 51 | GSIGSGDHYWS |
| 235 | 3748 | 52 | GGCTCCATCGGCAGTGGTGACCACTACTGGAGT |
| 235 | 3749 | 53 | YIYYSGTTYYNPSLKS |
| 235 | 3750 | 54 | TACATCTATTACAGTGGGACCACTTACTACAACCCGTC CCTCAAGAGT |
| 235 | 3751 | 55 | ARDGGYDHVWGTHRYFDK |
| 235 | 3752 | 56 | GCCAGAGATGGGGGTTATGATCACGTCTGGGGGACTC ATCGTTATTTCGACAAG |
| 235 | 3753 | 57 | GAAATTGTATTGACACAGTCTCCAGGCACCCTGTCTTT GTCTCCCGGGGAAAGAGCCACCCTCTCCTGCAGGGCC AGTCAGAGTGTTAGCAACAGTTACTTAGCCTGGTACC AGCAGAAACCTGGCCAGGCTCCCAGGCCTCCTCATCTA TGGTGTTTCCACCAGGGCCACTGGCATCCCAGACCGG TTCAGTGGCAGCGGGTCTGGGACAGACTTCACCCTCA CCATCAGCAGACTGGAACCTGAAGATTTTGCAATGTA TCACTGTCAGCAGTATGGTGCCTCACCTTGGACGTTCG GCCAAGGGACCAAAGTGGATATCAAA |

TABLE 6-continued

Informal Sequence Listing

| Antibody No. | Seq. Ref. No. | SEQ ID NO. | Sequence |
|---|---|---|---|
| 235 | 3754 | 58 | EIVLTQSPGTLSLSPGERATLSCRASQSVSNSYLAWYQQ KPGQAPRLLIYGVSTRATGIPDRFSGSGSGTDFTLTISRLE PEDFAMYHCQQYGASPWTFGQGTKVDIK |
| 235 | 3755 | 59 | RASQSVSNSYLA |
| 235 | 3756 | 60 | AGGGCCAGTCAGAGTGTTAGCAACAGTTACTTAGCC |
| 235 | 3757 | 61 | GVSTRAT |
| 235 | 3758 | 62 | GGTGTTTCCACCAGGGCCACT |
| 235 | 3759 | 63 | QQYGASPWT |
| 235 | 3760 | 64 | CAGCAGTATGGTGCCTCACCTTGGACG |
| 236 | 3761 | 65 | GAGGTGCAGCTGTTGGAGTCTGGAGGTGAGGTGAAGA AGCCTGGGGCCTCAGTGAAGGTCTCCTGCAGGGCCTC TGGTTACACCTTTAGAAACTATGGCCTCACCTGGGTGC GGCAGGCCCCCGGACAAGGGCTTGAGTGGATGGGAT GGATCAGCGCTTACAATGGAAACACAAACTATGCACA GAAGTTCCAGGGCAGAGTCACACTGACCACGGACACA TCCACGAGCACAGCCTACATGGAACTGAGGAGCCTAA GATCTGACGACACGGCCGTGTATTTCTGTGCGAGAGA CGTCCCCGGCCACGGCGCTGCCTTCATGGACGTCTGG GGCACAGGGACCACGGTCACCGTCTCCTCA |
| 236 | 3762 | 66 | EVQLLESGGEVKKPGASVKVSCRASGYTFRNYGLTWVR QAPGQGLEWMGWISAYNGNTNYAQKFQGRVTLTTDTS TSTAYMELRSLRSDDTAVYFCARDVPGHGAAFMDVWG TGTTVTVSS |
| 236 | 3763 | 67 | YTFRNYGLT |
| 236 | 3764 | 68 | TACACCTTTAGAAACTATGGCCTCACC |
| 236 | 3765 | 69 | WISAYNGNTNYAQKFQG |
| 236 | 3766 | 70 | TGGATCAGCGCTTACAATGGAAACACAAACTATGCAC AGAAGTTCCAGGGC |
| 236 | 3767 | 71 | ARDVPGHGAAFMDV |
| 236 | 3768 | 72 | GCGAGAGACGTCCCCGGCCACGGCGCTGCCTTCATGG ACGTC |
| 236 | 3769 | 73 | GACATCCAGTTGACCCAGTCTCCACTCTCCCTGCCCGT CACCCTTGGGCAGCCGGCCTCCATCTCCTGCAGGTCTA GTCAAAGCCTCGAAGCCAGTGATACAAATATCTACTT GAGTTGGTTTCAGCAGAGGCCAGGCCAATCTCCAAGG CGCCTAATTTATAAGATTTCTAACCGAGACTCTGGGGT CCCAGACAGATTCAGCGGCAGTGGGTCAGGCACTCAT TTCACACTGAGAATCAGCAGGGTGGAGGCTGACGATG TTGCGGTTTATTACTGCATGCAGGGTACACACTGGCCT CCGGCGTTCGGCCAGGGGACCAAAGTGGATATCAAA |
| 236 | 3770 | 74 | DIQLTQSPLSLPVTLGQPASISCRSSQSLEASDTNIYLSWF QQRPGQSPRRLIYKISNRDSGVPDRFSGSGSGTHFTLRISR VEADDVAVYYCMQGTHWPPAFGQGTKVDIK |
| 236 | 3771 | 75 | RSSQSLEASDTNIYLS |
| 236 | 3772 | 76 | AGGTCTAGTCAAAGCCTCGAAGCCAGTGATACAAATA TCTACTTGAGT |
| 236 | 3773 | 77 | KISNRDS |
| 236 | 3774 | 78 | AAGATTTCTAACCGAGACTCT |
| 236 | 3775 | 79 | MQGTHWPPA |
| 236 | 3776 | 80 | ATGCAGGGTACACACTGGCCTCCGGCG |

TABLE 6-continued

Informal Sequence Listing

| Antibody No. | Seq. Ref. No. | SEQ ID NO. | Sequence |
|---|---|---|---|
| 237 | 3777 | 81 | CAGGTCCAGCTGGTACAGTCTGGATCTGAGGTGAAGA AGCCTGGGGCCGCAGTGAAGGTCTCCTGCAAGGCTTC TGGTTACATCTTTGCCAACTTTGGTGTCAGCTGGGTGC GACAGGCCCCTGGACAAGGGCTTGAGTGGATGGGATG GATCAGCGCTTACAATGGTAACACAAACTATGCACAG AAGTTCCAGGGCAGAGTCATCATGACCACAGACACAT CCACGAGCACAGCCTACATGGAGCTGAGGAGCCTGAG ATCTGACGACACGGCCGTGTATTATTGTGCGAGAGAC CCCCCCGCCTACGCCGCTACATTGATGGACGTCTGGG GCAAAGGGACCACGGTCACTGTCTCCTCA |
| 237 | 3778 | 82 | QVQLVQSGSEVKKPGAAVKVSCKASGYIFANFGVSWVR QAPGQGLEWMGWISAYNGNTNYAQKFQGRVIMTTDTS TSTAYMELRSLRSDDTAVYYCARDPPAYAATLMDVWG KGTTVTVSS |
| 237 | 3779 | 83 | YIFANFGVS |
| 237 | 3780 | 84 | TACATCTTTGCCAACTTTGGTGTCAGC |
| 237 | 3781 | 85 | WISAYNGNTNYAQKFQG |
| 237 | 3782 | 86 | TGGATCAGCGCTTACAATGGTAACACAAACTATGCAC AGAAGTTCCAGGGC |
| 237 | 3783 | 87 | ARDPPAYAATLMDV |
| 237 | 3784 | 88 | GCGAGAGACCCCCCCGCCTACGCCGCTACATTGATGG ACGTC |
| 237 | 3785 | 89 | GAAATTGTATTGACGCAGTCTCCACTCTCCCTGCCCGT CACCCTTGGACAGTCGGCCTCCATCTCCTGCAGGTCTA GTCAAAGCCTCGAACACAGTGATACAAACACCTACTT GACTTGGTATCAGCAGAGGCCAGGCCAATCTCCAAGG CGGCTACTTTATAAGGTTTCTAACCGGGACTCTGGGGT CCCAGACAGATTCAGCGGCAGTGGGTCAGGCACTGAT TTCACACTGAAAATCAGCAGGGTGGAGGCTGAGGATG TTGGGGTTTATTACTGCATGCAAGGTACACACTGGCCT CCGACGTTCGGCCAAGGGACCAAAGTGGATATCAAA |
| 237 | 3786 | 90 | EIVLTQSPLSLPVTLGQSASISCRSSQSLEHSDTNTYLTWY QQRPGQSPRRLLYKVSNRDSGVPDRFSGSGSGTDFTLKIS RVEAEDVGVYYCMQGTHWPPTFGQGTKVDIK |
| 237 | 3787 | 91 | RSSQSLEHSDTNTYLT |
| 237 | 3788 | 92 | AGGTCTAGTCAAAGCCTCGAACACAGTGATACAAACA CCTACTTGACT |
| 237 | 3789 | 93 | KVSNRDS |
| 237 | 3790 | 94 | AAGGTTTCTAACCGGGACTCT |
| 237 | 3791 | 95 | MQGTHWPPT |
| 237 | 3792 | 96 | ATGCAAGGTACACACTGGCCTCCGACG |
| 238 | 3793 | 97 | CAGGTCCAGCTTGTACAGTCTGGGGCTGAGGTGAAGA AGCCTGGGTCCTCGGTGAGGGTCTCCTGCAAGGCCTC TGGAGGCACCTTCAGGGGCTATGGTCTCAGCTGGGTG CGACAGGCCCCTGGACAGGGACTCGAGTGGATGGGA GGGATCACCCATCTTTTTGGGACAGTCAGCTACGCTCC GAAGTTCCAGGGCAGACTCACGATCACCGCGGACGCA TCCACGGGCACAGCCTACATGGAGCTGAGCAGCCTGA TATCTGAGGACACGGCCGTATATTTTTGTGCGAGAGA TGCTTACGAAGTGTGGACCGGCTCTTATCTCCCCCCTT TTGACTACTGGGGCCAGGGAACAATGGTCACCGTCTC TTCA |
| 238 | 3794 | 98 | QVQLVQSGAEVKKPGSSVRVSCKASGGTFRGYGLSWVR QAPGQGLEWMGGITHLFGTVSYAPKFQGRLTITADAST GTAYMELSSLISEDTAVYFCARDAYEVWTGSYLPPFDY WGQGTMVTVSS |
| 238 | 3795 | 99 | GTFRGYGLS |

TABLE 6-continued

Informal Sequence Listing

| Antibody No. | Seq. Ref. No. | SEQ ID NO. | Sequence |
|---|---|---|---|
| 238 | 3796 | 100 | GGCACCTTCAGGGGCTATGGTCTCAGC |
| 238 | 3797 | 101 | GITHLFGTVSYAPKFQG |
| 238 | 3798 | 102 | GGGATCACCCATCTTTTTGGGACAGTCAGCTACGCTCCGAAGTTCCAGGGC |
| 238 | 3799 | 103 | ARDAYEVWTGSYLPPFDY |
| 238 | 3800 | 104 | GCGAGAGATGCTTACGAAGTGTGGACCGGCTCTTATCTCCCCCCTTTTGACTAC |
| 238 | 3801 | 105 | GATATTGTGATGACTCAGTCTCCAGGCACCCTGTCTTTGTCTCCCGGGGAAAGAGTCACCCTCTCCTGCAGGGCCAGTCAGATTATTCCAAGCAGTTACTTAGCCTGGTACCAGCAGAAACCTGGCCAGGCTCCCAGGCTCCTCATCTATGGTGCATTCACCAGGGCCACTGACATCCCAGACAGGTTCAGTGGCAGTGGGTCTGGGACAGACTTCACTCTCACCATCAGCAGACTGGAGCCTGAAGATTTTGCAGTATATTATTGTCAGCAGTATGGTAGTTCATTTCTCACTTTCGGCGGAGGGACCAAGGTGGAAATCAAA |
| 238 | 3802 | 106 | DIVMTQSPGTLSLSPGERVTLSCRASQIIPSSYLAWYQQKPGQAPRLLIYGAFTRATDIPDRFSGSGSGTDFTLTISRLEPEDFAVYYCQQYGSSFLTFGGGTKVEIK |
| 238 | 3803 | 107 | RASQIIPSSYLA |
| 238 | 3804 | 108 | AGGGCCAGTCAGATTATTCCAAGCAGTTACTTAGCC |
| 238 | 3805 | 109 | GAFTRAT |
| 238 | 3806 | 110 | GGTGCATTCACCAGGGCCACT |
| 238 | 3807 | 111 | QQYGSSFLT |
| 238 | 3808 | 112 | CAGCAGTATGGTAGTTCATTTCTCACT |
| 239 | 3809 | 113 | CAGGTCCAGCTTGTGCAGTCTGGGCCTGAGGTAAAGAAGCCTGGGTCCTCAGTGACGGTCTCCTGCAAGGCTTCTGGAGGCACCTTCAGCAACTATGGTATTGCTTGGGTGCGACAGGCCCCTGGACAAGGGCTTGAGTGGATGGGATCAACAATCCCTATCCTTGGAACAGCAAGCTACAGACAGAGCTTAAAGGACAGAGTCACAATTACCGCGGACGCTTCCACGACCACAGTCTACATGGAAATGACTCGCCTCAGAACTGAGGACACGGCCGTCTATTTTTGTGCGAGAGTTCCGGAGAGTCTTGTGGCATCAAACGCTTATGCTGTTTGGGGCCAAGGGACGGTGGTCACTGTCTCCTCA |
| 239 | 3810 | 114 | QVQLVQSGPEVKKPGSSVTVSCKASGGTFSNYGIAWVRQAPGQGLEWMGSTIPILGTASYRQSLKDRVTITADASTTTVYMEMTRLRTEDTAVYFCARVPESLVASNAYAVWGQGTVVTVSS |
| 239 | 3811 | 115 | GTFSNYGIA |
| 239 | 3812 | 116 | GGCACCTTCAGCAACTATGGTATTGCT |
| 239 | 3813 | 117 | STIPILGTASYRQSLKD |
| 239 | 3814 | 118 | TCAACAATCCCTATCCTTGGAACAGCAAGCTACAGACAGAGCTTAAAGGAC |
| 239 | 3815 | 119 | ARVPESLVASNAYAV |
| 239 | 3816 | 120 | GCGAGAGTTCCGGAGAGTCTTGTGGCATCAAACGCTTATGCTGTT |

TABLE 6-continued

Informal Sequence Listing

| Antibody No. | Seq. Ref. No. | SEQ ID NO. | Sequence |
|---|---|---|---|
| 239 | 3817 | 121 | GACATCCAGATGACCCAGTCTCCATCTTCCGTGTCTGC ATCTGTAGGAGACAGAGTCACCATCACTTGTCGGGCG AGCCAGGACATTAGCACCTGGTTAGCCTGGTATCAGC AGAGACCAGGGAAAGCCCCAAAACTCCTGATCTACAC TGCATCCAGTTTGCAAAGTGGGGTCCCATCAAGGTTC AGCGGCAGTGGATCTGGGACAGAGTTCACTCTCACCA TCAGCAGCCTGCAGCCTGAAGATTTTGCAACTTACTAT TGTCAACAGGGTACCAGTTTCCCATTCACTTTCGGCCC TGGGACCAAGCTGGAGATCAAA |
| 239 | 3818 | 122 | DIQMTQSPSSVSASVGDRVTITCRASQDISTWLAWYQQR PGKAPKLLIYTASSLQSGVPSRFSGSGSGTEFTLTISSLQP EDFATYYCQQGTSFPFTFGPGTKLEIK |
| 239 | 3819 | 123 | RASQDISTWLA |
| 239 | 3820 | 124 | CGGGCGAGCCAGGACATTAGCACCTGGTTAGCC |
| 239 | 3821 | 125 | TASSLQS |
| 239 | 3822 | 126 | ACTGCATCCAGTTTGCAAAGT |
| 239 | 3823 | 127 | QQGTSFPFT |
| 239 | 3824 | 128 | CAACAGGGTACCAGTTTCCCATTCACT |
| 240 | 3825 | 129 | GAGGTGCAGCTGGTGGAGTCTGGGGCTGAGATGAAG AAGCCTGGGGCCTCAGTGAAGGTTTCCTGCAAGGCTT CTGGATACACCTTCACTAACTATGCTATACATTGGGTG CGCCAGGCCCCCGGCCAAAGCCTTGAGTGGATGGGAT GGATCAACGCTGGCAATGGTAACACACAATATTCACA GAAGTTCCAGGGCAGAGTCACCTTTACCAGGGACACA TCCGCGAGCACGGTCTACATGGACCTGAGCAGCCTGA GATCTGAAGACACGGCTGTCTATTACTGTGCGAGAGG CCAAATTGTTGTTATACCACGTGCTAATTTCTGGTTCG ACCCCTGGGGCCAGGGAACCCTGGTCACCGTCTCCTC A |
| 240 | 3826 | 130 | EVQLVESGAEMKKPGASVKVSCKASGYTFTNYAIHWVR QAPGQSLEWMGWINAGNGNTQYSQKFQGRVTFTRDTS ASTVYMDLSSLRSEDTAVYYCARGQIVVIPRANFWFDP WGQGTLVTVSS |
| 240 | 3827 | 131 | YTFTNYAIH |
| 240 | 3828 | 132 | TACACCTTCACTAACTATGCTATACAT |
| 240 | 3829 | 133 | WINAGNGNTQYSQKFQG |
| 240 | 3830 | 134 | TGGATCAACGCTGGCAATGGTAACACACAATATTCAC AGAAGTTCCAGGGC |
| 240 | 3831 | 135 | ARGQIVVIPRANFWFDP |
| 240 | 3832 | 136 | GCGAGAGGCCAAATTGTTGTTATACCACGTGCTAATT TCTGGTTCGACCCC |
| 240 | 3833 | 137 | GATATTGTGCTGACCCAGTCTCCACTCTCCCTGCCCGT CACCCCTGGAGAGCCGGCCTCCATCTCCTGCAGGTCT AGTCAGAGCCTCCTGCATAGTCATGGATACAACTATT TGGATTGGTACTTGCAGAAGCCAGGGCAGTCTCCACA GCTCCTGATCTATTTGGGTTCTAATCGGGCCTCCGGGG TCCCTGACAGGTTCAGTGGCAGTGGATCAGGCACAGA TTTTACACTGAAAATCAGCAGAGTGGAGGCTGAGGAT GTTGGGGTTTATTACTGCATGCAAACTCTACAAACTCC GATCACCTTCGGCCAAGGGACACGAATGGAGATTAAA |
| 240 | 3834 | 138 | DIVLTQSPLSLPVTPGEPASISCRSSQSLLHSHGYNYLDW YLQKPGQSPQLLIYLGSNRASGVPDRFSGSGSGTDFTLKI SRVEAEDVGVYYCMQTLQTPITFGQGTRMEIK |
| 240 | 3835 | 139 | RSSQSLLHSHGYNYLD |
| 240 | 3836 | 140 | AGGTCTAGTCAGAGCCTCCTGCATAGTCATGGATACA ACTATTTGGAT |

TABLE 6-continued

Informal Sequence Listing

| Antibody No. | Seq. Ref. No. | SEQ ID NO. | Sequence |
|---|---|---|---|
| 240 | 3837 | 141 | LGSNRAS |
| 240 | 3838 | 142 | TTGGGTTCTAATCGGGCCTCC |
| 240 | 3839 | 143 | MQTLQTPIT |
| 240 | 3840 | 144 | ATGCAAACTCTACAAACTCCGATCACC |
| 241 | 3841 | 145 | GAGGTGCAGCTGCAGGAGTCGGGCCCAGGACTGGTG AAGCCTTTACAGACCCTGTCCGTCACCTGCAGTGTCTC TGGTGGCTCCATCAGCAGTGGTGATAACTACTGGAGC TGGATCCGCCAGCGCCCAGGGAAGGGCCTGGAGTGG ATTGGGTACATCTATTACAGTGGGACCACCTACTACA ATCCGTCCCTCAAGAGTCGAGTTACCATATCAGCAGA CAGGTCTAAGAATCAGTTTTCTCTGAAGATGAATTCTC TGAGTGCCGCGGACACGGCCGTGTATTACTGTGCGAG AGATGGCGGATATGATCACATCTGGGGGACTCATCGT TATTTCGCCCTCTGGGGCCAGGGAACCCTGGTCACCG TCTCCTCA |
| 241 | 3842 | 146 | EVQLQESGPGLVKPLQTLSVTCSVSGGSISSGDNYWSWI RQRPGKGLEWIGYIYYSGTTYYNPSLKSRVTISADRSKN QFSLKMNSLSAADTAVYYCARDGGYDHIWGTHRYFAL WGQGTLVTVSS |
| 241 | 3843 | 147 | GSISSGDNYWS |
| 241 | 3844 | 148 | GGCTCCATCAGCAGTGGTGATAACTACTGGAGC |
| 241 | 3845 | 149 | YIYYSGTTYYNPSLKS |
| 241 | 3846 | 150 | TACATCTATTACAGTGGGACCACCTACTACAATCCGTC CCTCAAGAGT |
| 241 | 3847 | 151 | ARDGGYDHIWGTHRYFAL |
| 241 | 3848 | 152 | GCGAGAGATGGCGGATATGATCACATCTGGGGGACTC ATCGTTATTTCGCCCTC |
| 241 | 3849 | 153 | GAAACGACACTCACGCAGTCTCCAGGCACCCTGTCTT TGTCTCCAGGGGAAAGAGCCACCCTCTCCTGCAGGGC CAGTCAGAGTGTTAACAGCGACTACTTGGCCTGGTAC CAGCAGAAACTTGGCCAGGCTCCCAGGCTCCTCATTT ATGGTGTATCCAACAGGGCCACTGGCATCCCAGACAG GTTTACTGGGAGTGGGTCTGGGACAGACTTCACTCTC ACCATCAGCAGACTGGAGCCTGAAGATTTTGCAGTCT ATCACTGTCAGCAGTATGGTACCTCACCGTGGACGTT CGGCCAAGGGACCAAGGTGGAGATCAAA |
| 241 | 3850 | 154 | ETTLTQSPGTLSLSPGERATLSCRASQSVNSDYLAWYQQ KLGQAPRLLIYGVSNRATGIPDRFTGSGSGTDFTLTISRLE PEDFAVYHCQQYGTSPWTFGQGTKVEIK |
| 241 | 3851 | 155 | RASQSVNSDYLA |
| 241 | 3852 | 156 | AGGGCCAGTCAGAGTGTTAACAGCGACTACTTGGCC |
| 241 | 3853 | 157 | GVSNRAT |
| 241 | 3854 | 158 | GGTGTATCCAACAGGGCCACT |
| 241 | 3855 | 159 | QQYGTSPWT |
| 241 | 3856 | 160 | CAGCAGTATGGTACCTCACCGTGGACG |
| 242 | 3857 | 161 | CAGGTCCAGCTTGTACAGTCTGGGGCTGAGGTGAAGA GGCCTGGGTCCTCGGTGAAAGTCTCCTGTAAGGCCTC TGGAGGCACCTTCAGTAGTTATGCTCTCTCCTGGGTAC GGCAGGCCCCTGGACAAGGACTTGAGTGGATAGGGG GGATCATCCCTATGCATCGTGTAACAAATTACGCACA GAAATTCGGGGCAGAGTCACAATTTCCGCGGACACA TCCACGAGTACGGCCTACTTGGAGGTGAACAGCCTGA GAGTTGAGGACACGGCCATGTATTACTGTGCGAGAGT |

TABLE 6-continued

Informal Sequence Listing

| Antibody No. | Seq. Ref. No. | SEQ ID NO. | Sequence |
|---|---|---|---|
| | | | GTTTTTCGGAACTTGTGGCGGTGCTTCGTGCTTCCCCT CTGACCTCTGGGGCCAGGGAACCCTGGTCACTGTCTC CTCA |
| 242 | 3858 | 162 | QVQLVQSGAEVKRPGSSVKVSCKASGGTFSSYALSWVR QAPGQGLEWIGGIIPMHRVTNYAQKFRGRVTISADTSTS TAYLEVNSLRVEDTAMYYCARVFFGTCGGASCFPSDLW GQGTLVTVSS |
| 242 | 3859 | 163 | GTFSSYALS |
| 242 | 3860 | 164 | GGCACCTTCAGTAGTTATGCTCTCTCC |
| 242 | 3861 | 165 | GIIPMHRVTNYAQKFRG |
| 242 | 3862 | 166 | GGGATCATCCCTATGCATCGTGTAACAAATTACGCAC AGAAATTTCGGGGC |
| 242 | 3863 | 167 | ARVFFGTCGGASCFPSDL |
| 242 | 3864 | 168 | GCGAGAGTGTTTTTCGGAACTTGTGGCGGTGCTTCGTG CTTCCCCTCTGACCTC |
| 242 | 3865 | 169 | GAAATTGTGTTGACACAGTCTCCATCCTTCGTGTCTGC TTCTGTCGGAGACGGGGTCACCATCACTTGCCGGGCC AGTCAGGCCATTAGCAGTTATTTAGCCTGGTATCAGC AAAAACCAGGGCAAGCCCCTAAACTCCTGATCTATGC TGCATCCACTTTGCAAGGTGGTGTCCCATCAAGGTTCA GCGGCAGTGGATCTGGGACACATTTCACTCTCACCAT CAGCAGCCTGCAGCCTGAAGATTTTGCAACTTATTACT GTCAGCAACTTCATAGTGATTTTCAGACTTTCGGCCCT GGGACCAAGGTGGAAATCAAA |
| 242 | 3866 | 170 | EIVLTQSPSFVSASVGDGVTITCRASQAISSYLAWYQQKP GQAPKLLIYAASTLQGGVPSRFSGSGSGTHFTLTISSLQPE DFATYYCQQLHSDFQTFGPGTKVEIK |
| 242 | 3867 | 171 | RASQAISSYLA |
| 242 | 3868 | 172 | CGGGCCAGTCAGGCCATTAGCAGTTATTTAGCC |
| 242 | 3869 | 173 | AASTLQG |
| 242 | 3870 | 174 | GCTGCATCCACTTTGCAAGGT |
| 242 | 3871 | 175 | QQLHSDFQT |
| 242 | 3872 | 176 | CAGCAACTTCATAGTGATTTTCAGACT |
| 243 | 3873 | 177 | CAGGTGCAGCTGGTGGAATCTGGGGGAGGCGTGGTCC AGCCTGGGAGGTCCCTGAGACTCTCCTGTGTAGCGTC TGGATTCAGCTTCAGTATGCATGGCATGCACTGGGTC CGCCAGGCTCCAGGCAAGGGGCTGGAGTGGGTGACA GCTATATGGTATGATGGAAGTAATAAATATTATGCAG ACTCCGTGAAGGGCCGATTCACGATCTCCAGAGACAA TTCTAGGAACACGCTGTATCTGCAAATGAACAGCCTG AGAGCCGAGGACACGGCTGTGTATTACTGTGCGAGAG ATCATGCCTCAACTCCATACTACATGGACGTCTGGGG CAAAGGGACCACGGTCACCGTCTCCTCA |
| 243 | 3874 | 178 | QVQLVESGGGVVQPGRSLRLSCVASGFSFSMHGMHWV RQAPGKGLEWVTAIWYDGSNKYYADSVKGRFTISRDNS RNTLYLQMNSLRAEDTAVYYCARDHASTPYYMDVWG KGTTVTVSS |
| 243 | 3875 | 179 | FSFSMHGMH |
| 243 | 3876 | 180 | TTCAGCTTCAGTATGCATGGCATGCAC |
| 243 | 3877 | 181 | AIWYDGSNKYYADSVKG |
| 243 | 3878 | 182 | GCTATATGGTATGATGGAAGTAATAAATATTATGCAG ACTCCGTGAAGGGC |
| 243 | 3879 | 183 | ARDHASTPYYMDV |

TABLE 6-continued

Informal Sequence Listing

| Antibody No. | Seq. Ref. No. | SEQ ID NO. | Sequence |
|---|---|---|---|
| 243 | 3880 | 184 | GCGAGAGATCATGCCTCAACTCCATACTACATGGACG TC |
| 243 | 3881 | 185 | GAAACGACACTCACGCAGTCTCCAGGCACCCTGTCTT TGTCTCCAGGGGAAAGCGCCACCCTCTCCTGCAGGAC CAGTCAGAGGATTAGCAGCACCTACTTAGCCTGGTAC CGGCAGAAACCTGGCCAGGCTCCCAGGCTCCTCATGT ATGGTGCATCCAGCAGGGCCACTGGCATCCCGGACAG GTTCAGTGGCAGTGGGTCTGGGACAGACTTCACTCTC ACCATCAGCAGTCTGGAGCCTGAAGATTTTGCACTAT ATTACTGTCAGCAGTATGGTAGCTTTCCGTGGACGTTC GGCCAAGGGACCAAGCTGGAGATCAAA |
| 243 | 3882 | 186 | ETTLTQSPGTLSLSPGESATLSCRTSQRISSTYLAWYRQK PGQAPRLLMYGASSRATGIPDRFSGSGSGTDFTLTISSLEP EDFALYYCQQYGSFPWTFGQGTKLEIK |
| 243 | 3883 | 187 | RTSQRISSTYLA |
| 243 | 3884 | 188 | AGGACCAGTCAGAGGATTAGCAGCACCTACTTAGCC |
| 243 | 3885 | 189 | GASSRAT |
| 243 | 3886 | 190 | GGTGCATCCAGCAGGGCCACT |
| 243 | 3887 | 191 | QQYGSFPWT |
| 243 | 3888 | 192 | CAGCAGTATGGTAGCTTTCCGTGGACG |
| 244 | 3889 | 193 | CAGGTGCAGCTACAGCAGTGGGGCGCAGGACTGTGG AAGCCTTCGCAGACCCTGTCCCTCACCTGCGCTGTCCA TGGTGGATCCCTCAGTGGCTACTCTTGGAGTTGGATCC GCCAGTCCCCAGGGAGGGGACTGGAGTGGATCGGCG AAGTCAATCGTAGGGGAACCACCAACTACAACCCCTC CCTCAAGGGTCGAGTCTCCATATCCTGGGACACGTCC AAGAACCAGGTCTCCCTGTCCCTGAGGTCTGTGACCG CCGCGGACACGGCTACATATTACTGTGCGGGGACCAA TGTTGGATTCGTTAATACCCATAACGACTACTACTTCG GTATGGACGTCTGGGGCCAAGGGACCACGGTCACCGT CTCCTCA |
| 244 | 3890 | 194 | QVQLQQWGAGLWKPSQTLSLTCAVHGGSLSGYSWSWI RQSPGRGLEWIGEVNRRGTTNYNPSLKGRVSISWDTSKN QVSLSLRSVTAADTATYYCAGTNVGFVNTHNDYYFGM DVWGQGTTVTVSS |
| 244 | 3891 | 195 | GSLSGYSWS |
| 244 | 3892 | 196 | GGATCCCTCAGTGGCTACTCTTGGAGT |
| 244 | 3893 | 197 | EVNRRGTTNYNPSLKG |
| 244 | 3894 | 198 | GAAGTCAATCGTAGGGGAACCACCAACTACAACCCCT CCCTCAAGGGT |
| 244 | 3895 | 199 | AGTNVGFVNTHNDYYFGMDV |
| 244 | 3896 | 200 | GCGGGGACCAATGTTGGATTCGTTAATACCCATAACG ACTACTACTTCGGTATGGACGTC |
| 244 | 3897 | 201 | GATATTGTGATGACTCAGTCTCCATCCTCCCTGTCTGC ATCGGTTGGAGACAGAGTCACCATCACTTGCCGGGCA AGTCAGAGCATAAGCAATTATGTAAATTGGTATCAGA AAAAAACAGGTCAAGTCCCTAAACTCCTGATCTATGG TGCATCCAATTTGGAAAGTGGGGTCCCATCAAGGTTC AGTGGCGGTGGATCTGGGACAGATTTCACTCTCACCA TCAGCAGTCTGCAACCTGAAGATTTTGCAACTTATTAC TGTCAACAGAGTTACAGTGTCCCGCTCACTTTCGGCG GAGGGACCAAGGTGGAAATCAAA |
| 244 | 3898 | 202 | DIVMTQSPSSLSASVGDRVTITCRASQSISNYVNWYQKK TGQVPKLLIYGASNLESGVPSRFSGGGSGTDFTLTISSLQP EDFATYYCQQSYSVPLTFGGGTKVEIK |
| 244 | 3899 | 203 | RASQSISNYVN |

TABLE 6-continued

Informal Sequence Listing

| Antibody No. | Seq. Ref. No. | SEQ ID NO. | Sequence |
|---|---|---|---|
| 244 | 3900 | 204 | CGGGCAAGTCAGAGCATAAGCAATTATGTAAAT |
| 244 | 3901 | 205 | GASNLES |
| 244 | 3902 | 206 | GGTGCATCCAATTTGGAAAGT |
| 244 | 3903 | 207 | QQSYSVPLT |
| 244 | 3904 | 208 | CAACAGAGTTACAGTGTCCCGCTCACT |
| 245 | 3905 | 209 | CAGGTCCAGCTTGTACAGTCTGGGGCTGAGGTGAAGA GGCCTGGATCCTCGGTGAAGGTCTCCTGCAAGGCGTC TGGAGGCACCTTCCGCGGCTACCATATCAGCTGGCTG CGCCAGGCCCCTGGACAGGGCCTCGAGTGGCTGGGAG GGATCACCCATTTGTTTGGGACAGTTAGTTACGCTCCG AAGTTCCAGGGCAGAGTCACCATCACCGCGGACGCAT CCACGGGCACACTTTACATGGTGTTGAACAGCCTGAA ACCTGAGGACACGGCCATTTATTATTGTGCGAGAGAT GCTTACGAGGTGTGGACTGGTTCTTATCTCCCCCCCITT TGACTACTGGGGCCAGGGAACCCTGGTCACCGTCTCC TCA |
| 245 | 3906 | 210 | QVQLVQSGAEVKRPGSSVKVSCKASGGTFRGYHISWLR QAPGQGLEWLGGITHLFGTVSYAPKFQGRVTITADASTG TLYMVLNSLKPEDTAIYYCARDAYEVWTGSYLPPFDYW GQGTLVTVSS |
| 245 | 3907 | 211 | GTFRGYHIS |
| 245 | 3908 | 212 | GGCACCTTCCGCGGCTACCATATCAGC |
| 245 | 3909 | 213 | GITHLFGTVSYAPKFQG |
| 245 | 3910 | 214 | GGGATCACCCATTTGTTTGGGACAGTTAGTTACGCTCC GAAGTTCCAGGGC |
| 245 | 3911 | 215 | ARDAYEVWTGSYLPPFDY |
| 245 | 3912 | 216 | GCGAGAGATGCTTACGAGGTGTGGACTGGTTCTTATC TCCCCCCTTTTGACTAC |
| 245 | 3913 | 217 | GAAACGACACTCACGCAGTCTCCAGGCACCCTGTCTT TGTCTCCCGGGGAAAGAGCCACCCTCTCTTGCAGGGC CAGTCAGACTGTTACAAGCAACTACTTAGCCTGGTAC CAGCAGAAACCTGGCCAGGCTCCCAGGCTCCTCATCT ATGATGCACTCACCAGGGCCACTGGCATCCCAGACAG GTTCAGTGGCAGTGGGTCTGGGACAGACTTCACTCTC ACCATCAGCAGACTGGAGCCTGAAGATTTTGCACTTT ATTATTGTCAGCAGTATGGTAGTTCATTCCTCACTTTC GGCGGAGGGACCAAAGTGGATATCAAA |
| 245 | 3914 | 218 | ETTLTQSPGTLSLSPGERATLSCRASQTVTSNYLAWYQQ KPGQAPRLLIYDALTRATGIPDRFSGSGSGTDFTLTISRLE PEDFALYYCQQYGSSFLTFGGGTKVDIK |
| 245 | 3915 | 219 | RASQTVTSNYLA |
| 245 | 3916 | 220 | AGGGCCAGTCAGACTGTTACAAGCAACTACTTAGCC |
| 245 | 3917 | 221 | DALTRAT |
| 245 | 3918 | 222 | GATGCACTCACCAGGGCCACT |
| 245 | 3919 | 223 | QQYGSSFLT |
| 245 | 3920 | 224 | CAGCAGTATGGTAGTTCATTCCTCACT |
| 246 | 3921 | 225 | CAGGTGCAGCTGCAGGAGTCCGGGGCTGAGGTGAAG AAGCCTGGGTCCTCGGTGAAGGTCTCCTGCAAGGCTT CTGGAGGCGCCTTCAGCAGCTATGCTATCAGCTGGGT GCGACAGGCCCCTGGACAGGGCCTCGAGTGGCTGGGA GGGATCACCCATTTGTTTGGGACAGTTAGTTACGCTCC GAAGTTCCAGGGCAGAGTCACCATCACCGCGGACGCA TCCACGGGCACACTTTACATGGTGTTGAACAGCCTGA AACCTGAGGACACGGCCATTTATTATTGTGCGAGAGA |

TABLE 6-continued

Informal Sequence Listing

| Antibody No. | Seq. Ref. No. | SEQ ID NO. | Sequence |
|---|---|---|---|
| | | | TGCTTACGAGGTGTGGACTGGTTCTTATCTCCCCCCTT TTTGACTACTGGGGCCAGGGAACCCTGGTCACCGTCTC CTCA |
| 246 | 3922 | 226 | QVQLQESGAEVKKPGSSVKVSCKASGGAFSSYAISWVR QAPGQGLEWLGGITHLFGTVSYAPKFQGRVTITADASTG TLYMVLNSLKPEDTAIYYCARDAYEVWTGSYLPPFDYW GQGTLVTVSS |
| 246 | 3923 | 227 | GAFSSYAIS |
| 246 | 3924 | 228 | GGCGCCTTCAGCAGCTATGCTATCAGC |
| 246 | 3925 | 229 | GITHLFGTVSYAPKFQG |
| 246 | 3926 | 230 | GGGATCACCCATTTGTTTGGGACAGTTAGTTACGCTCC GAAGTTCCAGGGC |
| 246 | 3927 | 231 | ARDAYEVWTGSYLPPFDY |
| 246 | 3928 | 232 | GCGAGAGATGCTTACGAGGTGTGGACTGGTTCTTATC TCCCCCCTTTTGACTAC |
| 246 | 3929 | 233 | GAAATTGTATTGACACAGTCTCCAGGCACCCTGTCTTT GTCTCCCGGGGAAAGAGCCACCCTCTCTTGCAGGGCC AGTCAGACTGTTACAAGCAACTACTTAGCCTGGTACC AGCAGAAACCTGGCCAGGCTCCCAGGCTCCTCATCTA TGATGCACTCACCAGGGCCACTGGCATCCCAGACAGG TTCAGTGGCAGTGGGTCTGGGACAGACTTCACTCTCA CCATCAGCAGACTGGAGCCTGAAGATTTTGCACTTTA TTATTGTCAGCAGTATGGTAGTTCATTCCTCACTTTCG GCGGAGGGACCAAGCTGGAGATCAAA |
| 246 | 3930 | 234 | EIVLTQSPGTLSLSPGERATLSCRASQTVTSNYLAWYQQ KPGQAPRLLIYDALTRATGIPDRFSGSGSGTDFTLTISRLE PEDFALYYCQQYGSSFLTFGGGTKLEIK |
| 246 | 3931 | 235 | RASQTVTSNYLA |
| 246 | 3932 | 236 | AGGGCCAGTCAGACTGTTACAAGCAACTACTTAGCC |
| 246 | 3933 | 237 | DALTRAT |
| 246 | 3934 | 238 | GATGCACTCACCAGGGCCACT |
| 246 | 3935 | 239 | QQYGSSFLT |
| 246 | 3936 | 240 | CAGCAGTATGGTAGTTCATTCCTCACT |
| 247 | 3937 | 241 | CAGGTCCAGCTGGTACAGTCTGGAGCTGAGGTGAAGG AGCCTGGGGCCTCAGTGAGGGTCTCCTGCAAGGCTTC TGGTTACACCTTTACCAGCTATGGTATCAGCTGGGTGC GACAGGCCCCTGGACAAGGGCTTGAGTGGATGGGATG GATCAGCGCTTACAATGGTAACACAAACTATGCACAG AAGTTCCAGGGCAGAGTCACCGTGACCACAGACACAT CCACGAGCGCAGCCTACATGGAGCTGAGGAGCCTGAG ATCTGACGACACGGCCATTTATTACTGTGCGAGAGAT TCATTTTCACTGACTGGTGCTGGATTTCCTGACTACTG GGGCCAGGGAACCCTGGTCACCGTCTCCTCA |
| 247 | 3938 | 242 | QVQLVQSGAEVKEPGASVRVSCKASGYTFTSYGISWVR QAPGQGLEWMGWISAYNGNTNYAQKFQGRVTVTTDTS TSAAYMELRSLRSDDTAIYYCARDSFSLTGAGFPDYWG QGTLVTVSS |
| 247 | 3939 | 243 | YTFTSYGIS |
| 247 | 3940 | 244 | TACACCTTTACCAGCTATGGTATCAGC |
| 247 | 3941 | 245 | WISAYNGNTNYAQKFQG |
| 247 | 3942 | 246 | TGGATCAGCGCTTACAATGGTAACACAAACTATGCAC AGAAGTTCCAGGGC |
| 247 | 3943 | 247 | ARDSFSLTGAGFPDY |

TABLE 6-continued

Informal Sequence Listing

| Antibody No. | Seq. Ref. No. | SEQ ID NO. | Sequence |
|---|---|---|---|
| 247 | 3944 | 248 | GCGAGAGATTCATTTTCACTGACTGGTGCTGGATTTCC TGACTAC |
| 247 | 3945 | 249 | GAAATTGTAATGACGCAGTCTCCACTCTCCCTGCCCGT CACCCTTGGACAGCCGGCCTCCATCTCCTGCAGGTCTA GTCAAAGCCTCGTATACAGTGATGGAAACACCTACTT GAATTGGTTTCAGCAGAGGCCAGGCCAATCTCCAAGG CGCCTAATTTATAAGGTTTCTAACCGGGACTCTGGGGT CCCAGACAGATTCAGCGGCAGTGGGTCAGACACTGAT TTCACACTGAAAATCAGCAGGGTGGAGGCTGAGGATG TTGGGGTTTATTACTGCATGCAAGCTACACAGTGGCCT CGCACGTTCGGCCAAGGGACCAAGGTGGAAATCAAA |
| 247 | 3946 | 250 | EIVMTQSPLSLPVTLGQPASISCRSSQSLVYSDGNTYLNW FQQRPGQSPRRLIYKVSNRDSGVPDRFSGSGSDTDFTLKI SRVEAEDVGVYYCMQATQWPRTFGQGTKVEIK |
| 247 | 3947 | 251 | RSSQSLVYSDGNTYLN |
| 247 | 3948 | 252 | AGGTCTAGTCAAAGCCTCGTATACAGTGATGGAAACA CCTACTTGAAT |
| 247 | 3949 | 253 | KVSNRDS |
| 247 | 3950 | 254 | AAGGTTTCTAACCGGGACTCT |
| 247 | 3951 | 255 | MQATQWPRT |
| 247 | 3952 | 256 | ATGCAAGCTACACAGTGGCCTCGCACG |
| 248 | 3953 | 257 | GAGGTGCAGCTGTTGGAGTCTGGGGGAGGCCTGGTCA AGCCTGGGGGGTCCCTGAGACTCTCCTGTGTAGCCTCT GGATTCACCTTCAGTAGCTATAACATCAACTGGGTCC GCCAGGCTCCAGGGAAGGGACTGGAGTGGGTCTCATC CATTAGTGGTGGTAGTAATTACATAGACTACGCAGAC TCAGTGAAGGGCCGATTCACCATCTCCAGAGACAACG CCAAGAACTCACTGTATTTGCAAATGAACAACCTGCG AGCCGAAGACACGGCTGTGTATTACTGTGCGAGACTT GGCTATGGTGGTAACCCGGAGCTTGACTATTGGGGCC AGGGAACCCTGGTCACTGTCTCCTCA |
| 248 | 3954 | 258 | EVQLLESGGGLVKPGGSLRLSCVASGFTFSSYNINWVRQ APGKGLEWVSSISGGSNYIDYADSVKGRFTISRDNAKNS LYLQMNNLRAEDTAVYYCARLGYGGNPELDYWGQGTL VTVSS |
| 248 | 3955 | 259 | FTFSSYNIN |
| 248 | 3956 | 260 | TTCACCTTCAGTAGCTATAACATCAAC |
| 248 | 3957 | 261 | SISGGSNYIDYADSVKG |
| 248 | 3958 | 262 | TCCATTAGTGGTGGTAGTAATTACATAGACTACGCAG ACTCAGTGAAGGGC |
| 248 | 3959 | 263 | ARLGYGGNPELDY |
| 248 | 3960 | 264 | GCGAGACTTGGCTATGGTGGTAACCCGGAGCTTGACT AT |
| 248 | 3961 | 265 | CAGTCTGTGCTGACGCAGCCGCCCTCAGTGTCTGGGG CCCCAGGACAGAGGGTCACCATCTCCTGCACCGGGAG CAGCTCCAACATCGGGGCAGGTTATGATGTACACTGG TACCAGCAACGTCCAGGAACAGCCCCCAAACTCCTCA TCTATGCTAATAACAATCGGCCCTCAGGGGTCCCTGA CCGATTCTCTGGCTCCAAGTCTGGCACCTCAGCCTCCC TGGCCATCACTGGGCTCCAGGCTGAGGATGAGGCTGA TTATTACTGCCAGTCCTATGACCTCAGTCGAGTAGTT CGAGGGTATTCGGCGGAGGGACCAAGCTGACCGTCCT C |
| 248 | 3962 | 266 | QSVLTQPPSVSGAPGQRVTISCTGSSSNIGAGYDVHWYQ QRPGTAPKLLIYANNNRPSGVPDRFSGSKSGTSASLAITG LQAEDEADYYCQSYDLSLSSSRVFGGGTKLTVL |

TABLE 6-continued

Informal Sequence Listing

| Antibody No. | Seq. Ref. No. | SEQ ID NO. | Sequence |
|---|---|---|---|
| 248 | 3963 | 267 | TGSSSNIGAGYDVH |
| 248 | 3964 | 268 | ACCGGGAGCAGCTCCAACATCGGGGCAGGTTATGATGTACAC |
| 248 | 3965 | 269 | ANNNRPS |
| 248 | 3966 | 270 | GCTAATAACAATCGGCCCTCA |
| 248 | 3967 | 271 | QSYDLSLSSSRV |
| 248 | 3968 | 272 | CAGTCCTATGACCTCAGTCTGAGTAGTTCGAGGGTA |
| 249 | 3969 | 273 | CAGGTCCAGCTGGTGCAGTCTGGGGGAGGCGTGGTCCAGCCTGGGAGGTCCCTGAAACACTCATGTGCAGCCTCTGGATTCACCTTCAATAACTATGCTATACACTGGGTCCGCCAGGCTCCAGGCAAGGGCCTGGAGTGGGTGGCAGCTATCTCATATGATGGAAGCAATGAATACTACTCAAACTCCGTGAAGGGCCGATTCACCATCTCCAGAGACAATTCCAAGTACACGCTGTATCTGCAAATGAACAGCCTGAGACCTGAGGACACGGCTGTGTATTACTGTGCGAGAGGCGCCTCCTATTACTATGTGAGTAGTGACCTTGGCTACTGGGGCCAGGGAACCCTGGTCACCGTCTCCTCA |
| 249 | 3970 | 274 | QVQLVQSGGGVVQPGRSLKHSCAASGFTFNNYAIHWVRQAPGKGLEWVAAISYDGSNEYYSNVKGRFTISRDNSKYTLYLQMNSLRPEDTAVYYCARGASYYYVSSDLGYWGQGTLVTVSS |
| 249 | 3971 | 275 | FTFNNYAIH |
| 249 | 3972 | 276 | TTCACCTTCAATAACTATGCTATACAC |
| 249 | 3973 | 277 | AISYDGSNEYYSNVKG |
| 249 | 3974 | 278 | GCTATCTCATATGATGGAAGCAATGAATACTACTCAAACTCCGTGAAGGGC |
| 249 | 3975 | 279 | ARGASYYYVSSDLGY |
| 249 | 3976 | 280 | GCGAGAGGCGCCTCCTATTACTATGTGAGTAGTGACCTTGGCTAC |
| 249 | 3977 | 281 | CAGCCTGTGCTGACTCAGCCGCCCTCAGTGTCTGGGGCCCCAGGGCAGAGGGTCACCATCTCCTGCACTGGGAGCAGCTCCAACATCGGGTCAGGTTATGATGTGCACTGGTATCAGCAGCTTCCAGGAACAGCCCCCAAAGTCGTCATCTATGGTAACATCAATCGGCCCTCAGGGGTCCCTGAGCGATTCTCTGGCTCCAAGTCTGGCACCTCAGCCTCCCTGGCCATCACTGGGCTCCAGGCTGAGGATGAGGCTGATTATTACTGCCAGTCCTATGACAGCCTGAGTGCCTCTTGGGTGTTCGGCGGAGGGACCAAGCTCACCGTCCTA |
| 249 | 3978 | 282 | QPVLTQPPSVSGAPGQRVTISCTGSSSNIGSGYDVHWYQQLPGTAPKVVIYGNINRPSGVPERFSGSKSGTSASLAITGLQAEDEADYYCQSYDSLSASWVFGGGTKLTVL |
| 249 | 3979 | 283 | TGSSSNIGSGYDVH |
| 249 | 3980 | 284 | ACTGGGAGCAGCTCCAACATCGGGTCAGGTTATGATGTGCAC |
| 249 | 3981 | 285 | GNINRPS |
| 249 | 3982 | 286 | GGTAACATCAATCGGCCCTCA |
| 249 | 3983 | 287 | QSYDSLSASWV |
| 249 | 3984 | 288 | CAGTCCTATGACAGCCTGAGTGCCTCTTGGGTG |
| 250 | 3985 | 289 | CAGGTCCAGCTTGTGCAGTCTGGACCAGAGGTGAAAAAGACCAGAGAGTCTCTGAAGATCTACTGTAAGGGTTCTGGATACAGCTTTATCAGCCACTGGATCGGCTGGGTGCGCCAGAAACCCGGGAAAGGCCTGGAGTGGATGGGGATCATCTATCCGGGTGACTCTGACACCAGATACAGCC |

TABLE 6-continued

Informal Sequence Listing

| Antibody No. | Seq. Ref. No. | SEQ ID NO. | Sequence |
|---|---|---|---|
| | | | CGTCCTTCCAAGGCCAGGTCGCCATCTCAGCCGACAA GTCCATCAACACCGCCTACCTGCAGTGGAGCAGCCTG AAGTCCTCGGACACCGCCATATATTACTGTGCGAGTG TAATGCTTCGGGGGATTATGTGGGGCCAGGGAACCCT GGTCACCGTCTCCTCA |
| 250 | 3986 | 290 | QVQLVQSGPEVKKTRESLKIYCKGSGYSFISHWIGWVRQ KPGKGLEWMGIIYPGDSDTRYSPSFQGQVAISADKSINT AYLQWSSLKSSDTAIYYCASVMLRGIMWGQGTLVTVSS |
| 250 | 3987 | 291 | YSFISHWIG |
| 250 | 3988 | 292 | TACAGCTTTATCAGCCACTGGATCGGC |
| 250 | 3989 | 293 | IIYPGDSDTRYSPSFQG |
| 250 | 3990 | 294 | ATCATCTATCCGGGTGACTCTGACACCAGATACAGCC CGTCCTTCCAAGGC |
| 250 | 3991 | 295 | ASVMLRGIM |
| 250 | 3992 | 296 | GCGAGTGTAATGCTTCGGGGGATTATG |
| 250 | 3993 | 297 | GACATCCGGTTGACCCAGTCTCCATCCTCCCTGTCTGC ATCTGTAGGAGACAGAGTCACCATCACTTGCCAGGCG AGTCAGGACATTAGCAAGTATCTAAATTGGTATCAGC AGAAACCAGGGAAAGCCCCTAAGCTCCTGATCTACGA TGCATCCAATTTGGAAACAGGGGTCCCATCAAGATTC AGTGGAAGTGGATCTGGGACAGATTTTACTTTCACCA TCAGCAGCCTGCAGCCTGAAGATATTGCAACATATTA CTGTCAGCCGTATGATAATCTCCCTCCGCCGCTCACTT TCGGCGGAGGGACCAAGCTGGAGATCAAA |
| 250 | 3994 | 298 | DIRLTQSPSSLSASVGDRVTITCQASQDISKYLNWYQQKP GKAPKLLIYDASNLETGVPSRFSGSGSGTDFTFTISSLQPE DIATYYCQPYDNLPPPLTFGGGTKLEIK |
| 250 | 3995 | 299 | QASQDISKYLN |
| 250 | 3996 | 300 | CAGGCGAGTCAGGACATTAGCAAGTATCTAAAT |
| 250 | 3997 | 301 | DASNLET |
| 250 | 3998 | 302 | GATGCATCCAATTTGGAAACA |
| 250 | 3999 | 303 | QPYDNLPPPLT |
| 250 | 4000 | 304 | CAGCCGTATGATAATCTCCCTCCGCCGCTCACT |
| 251 | 4001 | 305 | GAGGTGCAGCTGTTGGAGTCTGGGGGAGGCGTGGTCC AGTCTGGGAGGTCCCTGAGACTCTCCTGTGCAGCGTC TGGATTCACCTTCAGTGACAATGGCATGCACTGGGTC CGCCAGGCTCCAGGCAAGGGGCTGGAGTGGGTGGCA GGTATATTTTATGATGGAAGTAATAAACAATATGCAG ACTCCGTGAAGGGCCGATTCACCATCTCCAGAGACAA TTCCAAGAGCACGCTGTATCTGCAAATGAACAGCCTG AGAGCCGAGGACACGGCTGTGTATTACTGTGCGAGAG CCCCTTACGATATTTGGAGTGGTTATTGTCTTGACTAC TGGGGCCAGGGAACCCTGGTCACCGTCTCCTCA |
| 251 | 4002 | 306 | EVQLLESGGGVVQSGRSLRLSCAASGFTFSDNGMHWVR QAPGKGLEWVAGIFYDGSNKQYADSVKGRFTISRDNSK STLYLQMNSLRAEDTAVYYCARAPYDIWSGYCLDYWG QGTLVTVSS |
| 251 | 4003 | 307 | FTFSDNGMH |
| 251 | 4004 | 308 | TTCACCTTCAGTGACAATGGCATGCAC |
| 251 | 4005 | 309 | GIFYDGSNKQYADSVKG |
| 251 | 4006 | 310 | GGTATATTTTATGATGGAAGTAATAAACAATATGCAG ACTCCGTGAAGGGC |
| 251 | 4007 | 311 | ARAPYDIWSGYCLDY |

TABLE 6-continued

Informal Sequence Listing

| Antibody No. | Seq. Ref. No. | SEQ ID NO. | Sequence |
|---|---|---|---|
| 251 | 4008 | 312 | GCGAGAGCCCCTTACGATATTTGGAGTGGTTATTGTCT TGACTAC |
| 251 | 4009 | 313 | GACATCCAGATGACTCAGACTCCAGCCACCCTGTCTA TGTCTCCAGGGGAAAGAGCCACCCTCTCCTGCAGGGC CAGTCAGAGTGTTAACAACAACTTAGCCTGGTACCAG CAGAGACCTGGCCAGGCTCCCAGGCTCCTCATCTATG GTGCATCTACCAGGGCCACTGGTATCCCAGCCAGGTT CAGTGGCAGTGGGTCTGAGACAGAGTTCACTCTCACT ATCAGCAGCCTGCAGTCTGAAGATTTTGCGGTTTATCA CTGTCAGCAGTATAGTATCTGGCCTCAGACTTTTGGCC AGGGGACCAAGCTGGAGATCAAA |
| 251 | 4010 | 314 | DIQMTQTPATLSMSPGERATLSCRASQSVNNNLAWYQQ RPGQAPRLLIYGASTRATGIPARFSGSGSETEFTLTISSLQ SEDFAVYHCQQYSIWPQTFGQGTKLEIK |
| 251 | 4011 | 315 | RASQSVNNNLA |
| 251 | 4012 | 316 | AGGGCCAGTCAGAGTGTTAACAACAACTTAGCC |
| 251 | 4013 | 317 | GASTRAT |
| 251 | 4014 | 318 | GGTGCATCTACCAGGGCCACT |
| 251 | 4015 | 319 | QQYSIWPQT |
| 251 | 4016 | 320 | CAGCAGTATAGTATCTGGCCTCAGACT |
| 252 | 4017 | 321 | GAGGTGCAGCTGGTGGAGTCTGGGGGAGGCTTGGTCC AGCCTGGGGGGTCCCTGAGACTCTCCTGTGCAGCCTC TGGATTCACTATTGGAACGTACTGGATGAGCTGGGTC CGCCAGGCTCCAGGGAAGGGGCTGGAGTGGGTGGCC AACATAAAACCAGATGGAAGTGAGCAATATTATGGG GACTCGGTGAAGGGCCGATTCACCATCTCCAGAGACA ACGCCAAGAATTCCCTGTATCTGCAAATGCACAGCCT GAGAGCCGAGGACGCGGCTGTCTTTTACTGTGCGAGG GATACTCCCGACGTATTACGACATTTGGAGTGGCCCC CTGTAGGTGCTTTTGATATCTGGGGCCAAGGGACCAC GGTCACCGTCTCCTCA |
| 252 | 4018 | 322 | EVQLVESGGGLVQPGGSLRLSCAASGFTIGTYWMSWVR QAPGKGLEWVANIKPDGSEQYYGDSVKGRFTISRDNAK NSLYLQMHSLRAEDAAVFYCARDTPDVLRHLEWPPVG AFDIWGQGTTVTVSS |
| 252 | 4019 | 323 | FTIGTYWMS |
| 252 | 4020 | 324 | TTCACTATTGGAACGTACTGGATGAGC |
| 252 | 4021 | 325 | NIKPDGSEQYYGDSVKG |
| 252 | 4022 | 326 | AACATAAAACCAGATGGAAGTGAGCAATATTATGGG GACTCGGTGAAGGGC |
| 252 | 4023 | 327 | ARDTPDVLRHLEWPPVGAFDI |
| 252 | 4024 | 328 | GCGAGGGATACTCCCGACGTATTACGACATTTGGAGT GGCCCCCTGTAGGTGCTTTTGATATC |
| 252 | 4025 | 329 | GAAATTGTAATGACGCAGTCTCCAGACTCCCTGGCTG TGTCTCTGGGCGAGAGGGCCACCATCAACTGCAAGTC CAGCCAGAGTCTTTTCTACAGCTCCACCAATCAGCACT ACTTGGCTTGGTACCAGCAGAAACCAGGACAGCCTCC TGAGCTGCTCATTTACTGGGCATCTATCCGGGAATCCG GGGTCCCTGACCGATTCAGTGGCAGCGGGTCTGGGAC AGATTTCACTCTCACCATCAGCAGCCTGCAGGCCGCA GATGTGGCAGTTTATTACTGTCAGCAGTATTATAGTAG TCCTCAAACTTTTGGCCAGGGGACCAAGGTGGAAATC AAA |
| 252 | 4026 | 330 | EIVMTQSPDSLAVSLGERATINCKSSQSLFYSSTNQHYLA WYQQKPGQPPELLIYWASIRESGVPDRFSGSGSGTDFTL TISSLQAADVAVYYCQQYYSSPQTFGQGTKVEIK |

TABLE 6-continued

Informal Sequence Listing

| Antibody No. | Seq. Ref. No. | SEQ ID NO. | Sequence |
|---|---|---|---|
| 252 | 4027 | 331 | KSSQSLFYSSTNQHYLA |
| 252 | 4028 | 332 | AAGTCCAGCCAGAGTCTTTTCTACAGCTCCACCAATCAGCACTACTTGGCT |
| 252 | 4029 | 333 | WASIRES |
| 252 | 4030 | 334 | TGGGCATCTATCCGGGAATCC |
| 252 | 4031 | 335 | QQYYSSPQT |
| 252 | 4032 | 336 | CAGCAGTATTATAGTAGTCCTCAAACT |
| 253 | 4033 | 337 | CAGGTCCAGCTTGTGCAGTCTGGAACTGAGGTGAAGAAGCCTGGGGCCTCAGTGAAGGTCTCCTGTAAGGCTGCTGGTTACACCTTTAGCAACTACGGTGTCAGTTGGGTGCGACAGGCCCCTGGACAGGGGCTTGAGTGGATGGGATGGATCAGCGCTTATAATGGTAACACAAAATTTGCACAGAAGGTCCAGGGCAGACTCACCATGACCACAGACACATCTACCAGCACAGCCTACATGGAATTGAGGAACCTCAGATCCTGACGACACGGCCGTGTATTATTGTGCGAGAGAATCAGGGGCAACAGCGGCTGCTATGTTTGACTACTGGGGCCAGGGAACCCTGGTCACCGTCTCCTCA |
| 253 | 4034 | 338 | QVQLVQSGTEVKKPGASVKVSCKAAGYTFSNYGVSWVRQAPGQGLEWMGWISAYNGNTKFAQKVQGRLTMTDTSTSTAYMELRNLRSDDTAVYYCARESGATAAAMFDYWGQGTLVTVSS |
| 253 | 4035 | 339 | YTFSNYGVS |
| 253 | 4036 | 340 | TACACCTTTAGCAACTACGGTGTCAGT |
| 253 | 4037 | 341 | WISAYNGNTKFAQKVQG |
| 253 | 4038 | 342 | TGGATCAGCGCTTATAATGGTAACACAAAATTTGCACAGAAGGTCCAGGGC |
| 253 | 4039 | 343 | ARESGATAAAMFDY |
| 253 | 4040 | 344 | GCGAGAGAATCAGGGGCAACAGCGGCTGCTATGTTTGACTAC |
| 253 | 4041 | 345 | GAAATTGTATTGACGCAGTCTCCACTCTCCCTGCCCGTCACCCTTGGACAGCCGGCCTCCATCTCCTGCAGGTCTAGTCAAAGCCTCGAATACAGTGATGGAAACATCTACTTGAGTTGGTTTCAACAGAGGCCAGGCCAATCTCCAAGGCGCCTAATTTATAAGGTTTCTCACCGGGACTCTGGGGTCCCAGACAGATTCAGCGGCAGTGGGTCAGGCACTGATTTCACACTGAAAATCGCCAGGGTGGAGGCTGAGGATGTTGCAGTTTATTACTGCATGCAAGCTATACACTGGCCTCGAACTTTTGGCCAGGGGACCAAGGTGGAGATCAAA |
| 253 | 4042 | 346 | EIVLTQSPLSLPVTLGQPASISCRSSQSLEYSDGNIYLSWFQQRPGQSPRRLIYKVSHRDSGVPDRFSGSGSGTDFTLKIARVEAEDVAVYYCMQAIHWPRTFGQGTKVEIK |
| 253 | 4043 | 347 | RSSQSLEYSDGNIYLS |
| 253 | 4044 | 348 | AGGTCTAGTCAAAGCCTCGAATACAGTGATGGAAACATCTACTTGAGT |
| 253 | 4045 | 349 | KVSHRDS |
| 253 | 4046 | 350 | AAGGTTTCTCACCGGGACTCT |
| 253 | 4047 | 351 | MQAIHWPRT |
| 253 | 4048 | 352 | ATGCAAGCTATACACTGGCCTCGAACT |
| 254 | 4049 | 353 | GAGGTGCAGCTGGTGGAGTCTGGGGGAGGCGTGGTCCAGTCTGGGAGGTCCCTGAGACTCTCCTGTGCAGCGTCTGGATTCACCTTCAGTGACAATGGCATGCACTGGGTCCGCCAGGCTCCAGGCAAGGGGCTGGAGTGGGTGGCAGGTATATTTATGATGGAAGTAATAAACAATATGCAG |

TABLE 6-continued

Informal Sequence Listing

| Antibody No. | Seq. Ref. No. | SEQ ID NO. | Sequence |
|---|---|---|---|
| | | | ACTCCGTGAAGGGCCGATTCACCATCTCCAGAGACAA TTCCAAGAGCACGCTGTATCTGCAAATGAACAGCCTG AGAGCCGAGGACACGGCTGTGTATTACTGTGCGAGAG CCCCTTACGATATTTGGAGTGGTTATTGTCTTGACTAC TGGGGCCAGGGAACCCTGGTCACCGTCTCCTCA |
| 254 | 4050 | 354 | EVQLVESGGGVVQSGRSLRLSCAASGFTFSDNGMHWVR QAPGKGLEWVAGIFYDGSNKYADSVKGRFTISRDNSK STLYLQMNSLRAEDTAVYYCARAPYDIWSGYCLDYWG QGTLVTVSS |
| 254 | 4051 | 355 | FTFSDNGMH |
| 254 | 4052 | 356 | TTCACCTTCAGTGACAATGGCATGCAC |
| 254 | 4053 | 357 | GIFYDGSNKYADSVKG |
| 254 | 4054 | 358 | GGTATATTTTATGATGGAAGTAATAAACAATATGCAG ACTCCGTGAAGGGC |
| 254 | 4055 | 359 | ARAPYDIWSGYCLDY |
| 254 | 4056 | 360 | GCGAGAGCCCCTTACGATATTTGGAGTGGTTATTGTCT TGACTAC |
| 254 | 4057 | 361 | GACATCCGGTTGACCCAGTCTCCAGCCACCCTGTCTAT GTCTCCAGGGGAAAGAGCCACCCTCTCCTGCAGGGCC AGTCAGAGTGTTAACAACTTAGCCTGGTACCAGC AGAGACCTGGCCAGGCTCCCAGGCTCCTCATCTATGG TGCATCTACCAGGGCACTGGTATCCCAGCCAGGTTC AGTGGCAGTGGGTCTGAGACAGAGTTCACTCTCACTA TCAGCAGCCTGCAGTCTGAAGATTTTGCGGTTTATCAC TGTCAGCAGTATAGTATCTGGCCTCAGACTTTTGGCCA GGGGACCAAAGTGGATATCAAA |
| 254 | 4058 | 362 | DIRLTQSPATLSMSPGERATLSCRASQSVNNNLAWYQQR PGQAPRLLIYGASTRATGIPARFSGSGSETEFTLTISSLQSE DFAVYHCQQYSIWPQTFGQGTKVDIK |
| 254 | 4059 | 363 | RASQSVNNNLA |
| 254 | 4060 | 364 | AGGGCCAGTCAGAGTGTTAACAACAACTTAGCC |
| 254 | 4061 | 365 | GASTRAT |
| 254 | 4062 | 366 | GGTGCATCTACCAGGGCCACT |
| 254 | 4063 | 367 | QQYSIWPQT |
| 254 | 4064 | 368 | CAGCAGTATAGTATCTGGCCTCAGACT |
| 255 | 4065 | 369 | GAGGTGCAGCTGTTGGAGTCTGGGGGAGCCTTGGTCG AGCCTGGGGGGTCCCTGAGACTCTCCTGTGCAGCCTC TGGATTCTCCTTTAACACGTATTCCATGAACTGGGTCC GCCAGGGTCCAGGGAAGGGACTGGAGTGGGTCGCAA CGATAAGTACGAGTACTGCTGGCTCATACTACGCAGA CTCCGTGAGGGCCGGTTCACCATCTCTAGAGACAAT TCCAAGAACACGTTATATCTGCAAATGAACAGTCTGA GAGTCGAAGACACGGCCGTATATTACTGTGCGAGAGA TCAGGAAGTGGAACTGATCGATGATGCTTTTGATTTCT GGGGCCGGGGGACAATGGTCACCGTCTCTTCA |
| 255 | 4066 | 370 | EVQLLESGGALVEPGGSLRLSCAASGFSFNTYSMNWVR QGPGKGLEWVATISTSTAGSYYADSVRGRFTISRDNSKN TLYLQMNSLRVEDTAVYYCARDQEVELIDDAFDFWGR GTMVTVSS |
| 255 | 4067 | 371 | FSFNTYSMN |
| 255 | 4068 | 372 | TTCTCCTTTAACACGTATTCCATGAAC |
| 255 | 4069 | 373 | TISTSTAGSYYADSVRG |
| 255 | 4070 | 374 | ACGATAAGTACGAGTACTGCTGGCTCATACTACGCAG ACTCCGTGAGGGGC |

TABLE 6-continued

Informal Sequence Listing

| Antibody No. | Seq. Ref. No. | SEQ ID NO. | Sequence |
|---|---|---|---|
| 255 | 4071 | 375 | ARDQEVELIDDAFDF |
| 255 | 4072 | 376 | GCGAGAGATCAGGAAGTGGAACTGATCGATGATGCTTTTGATTTC |
| 255 | 4073 | 377 | GATATTGTGATGACTCAGACACATTCCTCCCTGTCTGCATCTGTGGGAGACAGAGTCACCATCACTTGCCGGGCCAGTCAGAGTATTAGTATCTGGGTGGCCTGGTATCAGCAGAAACCAGGGAAAGCCCCTAACCTCCTGATCTATAAGGCGTCTAGTTTACAAAGTGGGGTCCCATCAAGGTTCAGCGGCAGTGGATCTGGGACAGAATTCACTCTCACCATCAGCAGCCTGCAGCCTGATGACTCTGCAACTTATTACTGCCAACAGTATTACACCTATTACAGTTTTGGCCAGGGGACCAAGCTGGAGATCAAA |
| 255 | 4074 | 378 | DIVMTQTHSSLSASVGDRVTITCRASQSISIWVAWYQQKPGKAPNLLIYKASSLQSGVPSRFSGSGSGTEFTLTISSLQPDDSATYYCQQYYTYYSFGQGTKLEIK |
| 255 | 4075 | 379 | RASQSISIWVA |
| 255 | 4076 | 380 | CGGGCCAGTCAGAGTATTAGTATCTGGGTGGCC |
| 255 | 4077 | 381 | KASSLQS |
| 255 | 4078 | 382 | AAGGCGTCTAGTTTACAAAGT |
| 255 | 4079 | 383 | QQYYTYYS |
| 255 | 4080 | 384 | CAACAGTATTACACCTATTACAGT |
| 256 | 4081 | 385 | GAGGTGCAGCTGGTGGAGTCTGGGGCTGAGGTGAAGAGGCCTGGGGCCTCAGTGAAAATCTCCTGCAAGGCTTCTGAATACGCCTTCACCGCCCACTATCTTCACTGGGTGCGACAGGCCCCTGATCAAGGACTTGAGTGGATGGGATGGATCAGCCCTAAAAGTGGTGGCACCAACTATGCACAGAAGTTTCACGGCAGGGTCAGCATGACCAGTGACACGTCCATCAGTACAGTCTATATGGAACTGAGCAGCCTGACATCTGACGACACGGCCGTCTATTACTGTGCGAGAAGCAGTCTGGTGGGAGCAAGCCCCAACTTTGACTTCTGGGGCCAGGGAACCCTGGTCACCGTCTCCTCA |
| 256 | 4082 | 386 | EVQLVESGAEVKRPGASVKISCKASEYAFTAHYLHWVRQAPDQGLEWMGWISPKSGGTNYAQKFHGRVSMTSDTSISTVYMELSSLTSDDTAVYYCARSSLVGASPNFDFWGQGTLVTVSS |
| 256 | 4083 | 387 | YAFTAHYLH |
| 256 | 4084 | 388 | TACGCCTTCACCGCCCACTATCTTCAC |
| 256 | 4085 | 389 | WISPKSGGTNYAQKFHG |
| 256 | 4086 | 390 | TGGATCAGCCCTAAAAGTGGTGGCACCAACTATGCACAGAAGTTTCACGGC |
| 256 | 4087 | 391 | ARSSLVGASPNFDF |
| 256 | 4088 | 392 | GCGAGAAGCAGTCTGGTGGGAGCAAGCCCCAACTTTGACTTC |
| 256 | 4089 | 393 | CAGTCTGTGCTGACGCAGCCGCCCTCAGTGTCTGCGGCCCCAGGACAGAGGGTCACCATCTCCTGCTCTGGAAGCAGCTCCAACATTGGGAATAATTATGTATCCTGGTACCAGCAACTCCCAGGAACTACCCCCAAAGTCCTCATTTACGACAATAATCAGCGACCCTCAGGGATTCCTGACCGTTTCTCTGGCTCCAAGTCTGGCACGTCAGCCACCCTGGCCATCAGCGGACTCCAGACTGGCGACGAGGCCGTCTATTATTGCGGAACATGGGATGCCAGCCTGAGTGCTGCTATGGTTTTCGGCGGGGGGACCAAGCTCACCGTCCTA |
| 256 | 4090 | 394 | QSVLTQPPSVSAAPGQRVTISCSGSSSNIGNNYVSWYQQLPGTTPKVLIYDNNQRPSGIPDRFSGSKSGTSATLAISGLQTGDEAVYYCGTWDASLSAAMVFGGGTKLTVL |

TABLE 6-continued

Informal Sequence Listing

| Antibody No. | Seq. Ref. No. | SEQ ID NO. | Sequence |
|---|---|---|---|
| 256 | 4091 | 395 | SGSSSNIGNNYVS |
| 256 | 4092 | 396 | TCTGGAAGCAGCTCCAACATTGGGAATAATTATGTATCC |
| 256 | 4093 | 397 | DNNQRPS |
| 256 | 4094 | 398 | GACAATAATCAGCGACCCTCA |
| 256 | 4095 | 399 | GTWDASLSAAMV |
| 256 | 4096 | 400 | GGAACATGGGATGCCAGCCTGAGTGCTGCTATGGTT |
| 257 | 4097 | 401 | CAGGTGCAGCTGCAGGAGTCGGGCCCAGGACTGGTGAAGCCTTCGGAGACCCTGTCCCTCACCTGCACTGTCTCTGGTGGCTCCATCAGCGGATATTACTGGAGCTGGATCCGGCAGCCCCCAGGGAGGGGACTGGAGTGGATTGGGTTTATTTATTATAGTGGGAGTACCAGCTACGACTCCTCCCTCAAGAGTCGAGTCACCATATCAGTAGACACGTCCAAGAACCAGTTCTCCCTAAACCTGAGCTCTGTGACCGCTGCGGACACGGCCGTATATTACTGTGCGAGAAGTACATGGGACTACGGTGACCACTTTCCGTTTGACTACTGGGGCCAGGGAACCCTGGTCACCGTCTCCTCA |
| 257 | 4098 | 402 | QVQLQESGPGLVKPSETLSLTCTVSGGSISGYYWSWIRQPPGRGLEWIGFIYYSGSTSYDSSLKSRVTISVDTSKNQFSLNLSSVTAADTAVYYCARSTWDYGDHFPFDYWGQGTLVTVSS |
| 257 | 4099 | 403 | GSISGYYWS |
| 257 | 4100 | 404 | GGCTCCATCAGCGGATATTACTGGAGC |
| 257 | 4101 | 405 | FIYYSGSTSYDSSLKS |
| 257 | 4102 | 406 | TTTATTTATTATAGTGGGAGTACCAGCTACGACTCCTCCCTCAAGAGT |
| 257 | 4103 | 407 | ARSTWDYGDHFPFDY |
| 257 | 4104 | 408 | GCGAGAAGTACATGGGACTACGGTGACCACTTTCCGTTTGACTAC |
| 257 | 4105 | 409 | TCCTATGAGCTGACTCAGCCACCCTCAGTGTCAGTGGCCCCAGGAAAGACGGCCAGGATTACCTGTGGGGGAACAACATTGGAATTAAAGATGTGCACTGGTACCAACTGAGGCCAGGCCAGGCCCCTGTGTTGGTCATCTCTTATGATAGCGACCGGCCCTCAGGGATCCCTGAGCGATTCTCTGGCTCCAACTCTGGGAACACGGCCACCCTGACCATCAGCAGGGTCGAAGCCGGGGATGAGGCCGACTATTTCTGTCAGGTGTGGGATAGTAGTCCTGATCATCCTTATGTCTTCGGAACTGGGACCAAGCTCACCGTCCTA |
| 257 | 4106 | 410 | SYELTQPPSVSVAPGKTARITCGGNNIGIKDVHWYQLRPGQAPVLVISYDSDRPSGIPERFSGSNSGNTATLTISRVEAGDEADYFCQVWDSSPDHPYVFGTGTKLTVL |
| 257 | 4107 | 411 | GGNNIGIKDVH |
| 257 | 4108 | 412 | GGGGGAAACAACATTGGAATTAAAGATGTGCAC |
| 257 | 4109 | 413 | YDSDRPS |
| 257 | 4110 | 414 | TATGATAGCGACCGGCCCTCA |
| 257 | 4111 | 415 | QVWDSSPDHPYV |
| 257 | 4112 | 416 | CAGGTGTGGGATAGTAGTCCTGATCATCCTTATGTC |
| 258 | 4113 | 417 | GAGGTGCAGCTGGTGGAGTCTGGAGGTGAGGTGAAGAAGCCTGGGGCCTCAGTGAAGGTCTCCTGCAGGGCCTCTGGTTACACCTTTAGAAACTATGGCCTCACCTGGGTGCGGCAGGCCCCCGGACAAGGGCTTGAGTGGATGGGATGGATCAGCGCTTACAATGGAAACACAAACTATGCACAGAAGTTCCAGGGCAGAGTCACACTGACCACGGACACA |

TABLE 6-continued

Informal Sequence Listing

| Antibody No. | Seq. Ref. No. | SEQ ID NO. | Sequence |
|---|---|---|---|
| | | | TCCACGAGCACAGCCTACATGGAACTGAGGAGCCTAA GATCTGACGACACGGCCGTGTATTTCTGTGCGAGAGA CGTCCCCGGCCACGGCGCTGCCTTCATGGACGTCTGG GGCACAGGGACCACGGTCACCGTCTCCTCA |
| 258 | 4114 | 418 | EVQLVESGGEVKKPGASVKVSCRASGYTFRNYGLTWVR QAPGQGLEWMGWISAYNGNTNYAQKFQGRVTLTTDTS TSTAYMELRSLRSDDTAVYFCARDVPGHGAAFMDVWG TGTTVTVSS |
| 258 | 4115 | 419 | YTFRNYGLT |
| 258 | 4116 | 420 | TACACCTTTAGAAACTATGGCCTCACC |
| 258 | 4117 | 421 | WISAYNGNTNYAQKFQG |
| 258 | 4118 | 422 | TGGATCAGCGCTTACAATGGAAACACAAACTATGCAC AGAAGTTCCAGGGC |
| 258 | 4119 | 423 | ARDVPGHGAAFMDV |
| 258 | 4120 | 424 | GCGAGAGACGTCCCCGGCCACGGCGCTGCCTTCATGG ACGTC |
| 258 | 4121 | 425 | GAAACGACACTCACGCAGTCTCCACTCTCCCTGCCCG TCACCCTTGGGCAGCCGGCCTCCATCTCCTGCAGGTCT AGTCAAAGCCTCGAAGCCAGTGATACAAATATCTACT TGAGTTGGTTTCAGCAGAGGCCAGGCCAATCTCCAAG GCGCCTAATTTATAAGATTTCTAACCGAGACTCTGGG GTCCCAGACAGATTCAGCGGCAGTGGGTCAGGCACTC ATTTCACACTGAGAATCAGCAGGGTGGAGGCTGACGA TGTTGCGGTTTATTACTGCATGCAGGGTACACACTGG CTCCGGCGTTCGGCCAGGGGACCAAGCTGGAGATCAA A |
| 258 | 4122 | 426 | ETTLTQSPLSLPVTLGQPASISCRSSQSLEASDTNIYLSWF QQRPGQSPRRLIYKISNRDSGVPDRFSGSGSGTHFTLRISR VEADDVAVYYCMQGTHWPPAFGQGTKLEIK |
| 258 | 4123 | 427 | RSSQSLEASDTNIYLS |
| 258 | 4124 | 428 | AGGTCTAGTCAAAGCCTCGAAGCCAGTGATACAAATA TCTACTTGAGT |
| 258 | 4125 | 429 | KISNRDS |
| 258 | 4126 | 430 | AAGATTTCTAACCGAGACTCT |
| 258 | 4127 | 431 | MQGTHWPPA |
| 258 | 4128 | 432 | ATGCAGGGTACACACTGGCCTCCGGCG |
| 259 | 4129 | 433 | GAGGTGCAGCTGGTGGAGTCTGGATCTGAGGTGAAGA AGCCTGGGGCCGCAGTGAAGGTATCCTGCAAGGCTTC TGGTTACATCTTTGCCAACTTTGGTGTCAGCTGGGTGC GACAGGCCCCTGGACAAGGGCTTGAGTGGATGGGATG GATCAGCGCTTACAATGGTAACACAAACTATGCACAG AAGTTCCAGGGCAGAGTCATCATGACCACAGACACAT CCACGAGCACAGCCTACATGGAGCTGAGGAGCCTGAG ATCTGACGACACGGCCGTGTATTATTGTGCGAGAGAC CCCCCCGCCTACGCCGCTACATTGATGGACGTCTGGG GCAAAGGGACCACGGTCACCGTCTCCTCA |
| 259 | 4130 | 434 | EVQLVESGSEVKKPGAAVKVSCKASGYIFANFGVSWVR QAPGQGLEWMGWISAYNGNTNYAQKFQGRVIMTTDTS TSTAYMELRSLRSDDTAVYYCARDPPAYAATLMDVWG KGTTVTVSS |
| 259 | 4131 | 435 | YIFANFGVS |
| 259 | 4132 | 436 | TACATCTTTGCCAACTTTGGTGTCAGC |
| 259 | 4133 | 437 | WISAYNGNTNYAQKFQG |

TABLE 6-continued

Informal Sequence Listing

| Antibody No. | Seq. Ref. No. | SEQ ID NO. | Sequence |
|---|---|---|---|
| 259 | 4134 | 438 | TGGATCAGCGCTTACAATGGTAACACAAACTATGCAC AGAAGTTCCAGGGC |
| 259 | 4135 | 439 | ARDPPAYAATLMDV |
| 259 | 4136 | 440 | GCGAGAGACCCCCCCGCCTACGCCGCTACATTGATGG ACGTC |
| 259 | 4137 | 441 | GATATTGTGATGACTCAGTCTCCACTCTCCCTGCCCGT CACCCTTGGACAGTCGGCCTCCATCTCCTGCAGGTCTA GTCAAAGCCTCGAACACAGTGATACAAACACCTACTT GACTTGGTATCAGCAGAGGCCAGGCCAATCTCCAAGG CGGCTACTTTATAAGGTTTCTAACCGGGACTCTGGGGT CCCAGACAGATTCAGCGGCAGTGGGTCAGGCACTGAT TTCACACTGAAAATCAGCAGGGTGGAGGCTGAGGATG TTGGGGTTTATTACTGCATGCAAGGTACACACTGGCCT CCGACGTTCGGCCAAGGGACCAAGCTGGAGATCAAA |
| 259 | 4138 | 442 | DIVMTQSPLSLPVTLGQSASISCRSSQSLEHSDTNTYLTW YQQRPGQSPRRLLYKVSNRDSGVPDRFSGSGSGTDFTLK ISRVEAEDVGVYYCMQGTHWPPTFGQGTKLEIK |
| 259 | 4139 | 443 | RSSQSLEHSDTNTYLT |
| 259 | 4140 | 444 | AGGTCTAGTCAAAGCCTCGAACACAGTGATACAAACA CCTACTTGACT |
| 259 | 4141 | 445 | KVSNRDS |
| 259 | 4142 | 446 | AAGGTTTCTAACCGGGACTCT |
| 259 | 4143 | 447 | MQGTHWPPT |
| 259 | 4144 | 448 | ATGCAAGGTACACACTGGCCTCCGACG |
| 260 | 4145 | 449 | GAGGTGCAGCTGGTGGAGTCTGGCCCAACACTGGTGA AGCCTTCGGAGACCCTGTCCCTCACCTGCGTTGTCTCT GGTGGCTCCGTCTACAGGAGTAGTAACTACTGGGCCT GGATCCGCCAGCCCCCAGGGAAGGGGCTGGAGTGGA TCGGGAGTGTCTATCATAGTGGGAACCCCTACTCCAA CCCGTCCCTTCAGAGTCGAGTCTCCGTCTCCATTGACA CGTCCAAGAACCAGTTCTCCCTGAAGCTGTACTCTGTG ACCGCCGCAGACTCGGCTATTTATTATTGTGCGTGTAA AAGAGCGGACGCTGACGACGTAGATTACGTGGCGGG CCTCACCGGTTTCCCCTGGTACTTCGATGTCTGGGGCC GTGGCACCCTGGTCACCGTCTCCTCA |
| 260 | 4146 | 450 | EVQLVESGPTLVKPSETLSLTCVVSGGSVYRSSNYWAWI RQPPGKGLEWIGSVYHSGNPYSNPSLQSRVSVSIDTSKN QFSLKLYSVTAADSAIYYCACKRADADDVDYVAGLTGF PWYFDVWGRGTLVTVSS |
| 260 | 4147 | 451 | GSVYRSSNYWA |
| 260 | 4148 | 452 | GGCTCCGTCTACAGGAGTAGTAACTACTGGGCC |
| 260 | 4149 | 453 | SVYHSGNPYSNPSLQS |
| 260 | 4150 | 454 | AGTGTCTATCATAGTGGGAACCCCTACTCCAACCCGT CCCTTCAGAGT |
| 260 | 4151 | 455 | ACKRADADDVDYVAGLTGFPWYFDV |
| 260 | 4152 | 456 | GCGTGTAAAAGAGCGGACGCTGACGACGTAGATTACG TGGCGGGCCTCACCGGTTTCCCCTGGTACTTCGATGTC |
| 260 | 4153 | 457 | GAAATTGTGTTGACGCAGTCTCCGTCCACCCTGTCTGC ATCTGTGGGAGACAGAGTCACCATCACTTGCCGGGCC AGTCAGAGTATTAGTAGTTGGTTGGCCTGGTATCAGC AGAAACCAGGGAAAACCCCTAAGTTGCTCATCTATAA GGCGTCTACTTTAGAAAGTGGGGTCCCATCAAGGTTC AGCGGCAGCGGATCTGGGACAGAATTCACTCTCACCA TCAGCAGCCTGCAGCCTGATGATTTCGCAACCTACTA CTGCCAACAGTATCATGTTTATTCCCGCTCACTTTCG GCGGAGGGACCAAGGTGGAAATCAAA |

TABLE 6-continued

Informal Sequence Listing

| Antibody No. | Seq. Ref. No. | SEQ ID NO. | Sequence |
|---|---|---|---|
| 260 | 4154 | 458 | EIVLTQSPSTLSASVGDRVTITCRASQSISSWLAWYQQKP GKTPKLLIYKASTLESGVPSRFSGSGSGTEFTLTISSLQPD DFATYYCQQYHVYFPLTFGGGTKVEIK |
| 260 | 4155 | 459 | RASQSISSWLA |
| 260 | 4156 | 460 | CGGGCCAGTCAGAGTATTAGTAGTTGGTTGGCC |
| 260 | 4157 | 461 | KASTLES |
| 260 | 4158 | 462 | AAGGCGTCTACTTTAGAAAGT |
| 260 | 4159 | 463 | QQYHVYFPLT |
| 260 | 4160 | 464 | CAACAGTATCATGTTTATTTCCCGCTCACT |
| 261 | 4161 | 465 | GAGGTGCAGCTGGTGGAGTCTGGGGGAGGCGTGGTCC AGCCTGGGAGGTCCCTGAGACTCTCCTGTGTAGCGTC TGGATTCAGCTTCAGTATGCATGGCATGCACTGGGTC CGCCAGGCTCCAGGCAAGGGGCTGGAGTGGGTGACA GCTATATGGTATGATGGAAGTAATAAATATTATGCAG ACTCCGTGAAGGGCCGATTCACGATCTCCAGAGACAA TTCTAGGAACACGCTGTATCTGCAAATGAACAGCCTG AGAGCCGAGGACACGGCTGTGTATTACTGTGCGAGAG ATCATGCCTCAACTCCATACTACATGGACGTCTGGGG CAAAGGGACCACGGTCACCGTCTCTTCA |
| 261 | 4162 | 466 | EVQLVESGGGVVQPGRSLRLSCVASGFSFSMHGMHWV RQAPGKGLEWVTAIWYDGSNKYYADSVKGRFTISRDNS RNTLYLQMNSLRAEDTAVYYCARDHASTPYYMDVWG KGTTVTVSS |
| 261 | 4163 | 467 | FSFSMHGMH |
| 261 | 4164 | 468 | TTCAGCTTCAGTATGCATGGCATGCAC |
| 261 | 4165 | 469 | AIWYDGSNKYYADSVKG |
| 261 | 4166 | 470 | GCTATATGGTATGATGGAAGTAATAAATATTATGCAG ACTCCGTGAAGGGC |
| 261 | 4167 | 471 | ARDHASTPYYMDV |
| 261 | 4168 | 472 | GCGAGAGATCATGCCTCAACTCCATACTACATGGACG TC |
| 261 | 4169 | 473 | GAAACGACACTCACGCAGTCTCCAGGCACCCTGTCTT TGTCTCCAGGGGAAAGCGCCACCCTCTCCTGCAGGAC CAGTCAGAGGATTAGCAGCACCTACTTAGCCTGGTAC CGGCAGAAACCTGGCCAGGCTCCCAGGCTCCTCATGT ATGGTGCATCCAGCAGGGCCACTGGCATCCCGGACAG GTTCAGTGGCAGTGGGTCTGGGACAGACTTCACTCTC ACCATCAGCAGTCTGGAGCCTGAAGATTTTGCACTAT ATTACTGTCAGCAGTATGGTAGCTTTCCGTGGACGTTC GGCCAAGGGACCAAGGTGGAAATCAAA |
| 261 | 4170 | 474 | ETTLTQSPGTLSLSPGESATLSCRTSQRISSTYLAWYRQK PGQAPRLLMYGASSRATGIPDRFSGSGSGTDFTLTISSLEP EDFALYYCQQYGSFPWTFGQGTKVEIK |
| 261 | 4171 | 475 | RTSQRISSTYLA |
| 261 | 4172 | 476 | AGGACCAGTCAGAGGATTAGCAGCACCTACTTAGCC |
| 261 | 4173 | 477 | GASSRAT |
| 261 | 4174 | 478 | GGTGCATCCAGCAGGGCCACT |
| 261 | 4175 | 479 | QQYGSFPWT |
| 261 | 4176 | 480 | CAGCAGTATGGTAGCTTTCCGTGGACG |
| 262 | 4177 | 481 | CAGGTCCAGCTGGTGCAGTCTGGGCCTGAGGTGAAGA AGCCTGGGTCCTCGGTGAAGGTCTCCTGCAAGGCTTC TGGAGGCACCTTCAGCAGTTATGCTATCACGTGGGTG |

TABLE 6-continued

Informal Sequence Listing

| Antibody No. | Seq. Ref. No. | SEQ ID NO. | Sequence |
|---|---|---|---|
| | | | CGACAGGCCCTGGACAAGGGCTTGAGTGGATGGGG<br>GGGATCATCCCTTCCTTTGATAGAGTGGACTATTCACG<br>GAACTTCAAGGGGAGAGTCACCTTTACCGCGGACAAA<br>TCCGCGAACACGGCCTACATGGAACTGACCAATGTGA<br>GATCCGACGACACGGCCGTGTATTACTGTGCGAGAGG<br>CTGTTGTGGGGCTGTGGCTGGATTCCAGCACTGGGGC<br>CAGGGCACCGGGGTCACCGTCTCCTCA |
| 262 | 4178 | 482 | QVQLVQSGPEVKKPGSSVKVSCKASGGTFSSYAITWVR<br>QAPGQGLEWMGGIIPSFDRVDYSRNFKGRVTFTADKSA<br>NTAYMELTNVRSDDTAVYYCARGCCGAVAGFQHWGQ<br>GTGVTVSS |
| 262 | 4179 | 483 | GTFSSYAIT |
| 262 | 4180 | 484 | GGCACCTTCAGCAGTTATGCTATCACG |
| 262 | 4181 | 485 | GIIPSFDRVDYSRNFKG |
| 262 | 4182 | 486 | GGGATCATCCCTTCCTTTGATAGAGTGGACTATTCACG<br>GAACTTCAAGGGG |
| 262 | 4183 | 487 | ARGCCGAVAGFQH |
| 262 | 4184 | 488 | GCGAGAGGCTGTTGTGGGGCTGTGGCTGGATTCCAGC<br>AC |
| 262 | 4185 | 489 | GATATTGTGCTGACGCAGACTCCAGCCACCCTGTCTTT<br>ATCTCCAGGGGAAACAGCCACCCTCTCCTGCAGGGCC<br>AGTCAGAGTGTTACCACCTACTTAGCCTGGTACCAGC<br>AGAAACCTGGCCAGGCTCCCAGGCTCCTCATCTATGA<br>TGCATCCAACAGGGCCACTGGCGTCCCAACCAGGTTC<br>AGTGGCAGTGGGTCTGGGACAGACTTCACTCTCACCA<br>TCAGCAGCCTGGAGCCTGAAGATTATGCGATTTATTA<br>CTGTCAGCAACGTACTACCGGGGTCACTTTCGGCGGG<br>GGGACCAAGGTGGAAATCAAA |
| 262 | 4186 | 490 | DIVLTQTPATLSLSPGETATLSCRASQSVTTYLAWYQQK<br>PGQAPRLLIYDASNRATGVPTRFSGSGSGTDFTLTISSLEP<br>EDYAIYYCQQRTTGVTFGGGTKVEIK |
| 262 | 4187 | 491 | RASQSVTTYLA |
| 262 | 4188 | 492 | AGGGCCAGTCAGAGTGTTACCACCTACTTAGCC |
| 262 | 4189 | 493 | DASNRAT |
| 262 | 4190 | 494 | GATGCATCCAACAGGGCCACT |
| 262 | 4191 | 495 | QQRTTGVT |
| 262 | 4192 | 496 | CAGCAACGTACTACCGGGGTCACT |
| 263 | 4193 | 497 | CAGGTGCAGCTGGTGGAGTCTGGGGGAGGCCTGGTCA<br>AGCCTGGGGGGTCCCTGAGACTCTCTTGTGCAGCCTCT<br>GGATTCACCTTCAGTAGTTTTGGCATGCATTGGGTCCG<br>CCAGGCTCCAGGGCAGGGACTGGAGTGGGTCGCATCC<br>ATTACTGGTGGCAGCAGTTACATAAACTACGCAGACT<br>CAGTGAAGGGCCGATTCACCATCTCCAGAGACAACGC<br>CAAGAAGTCACTGTCTCTGCAAATGAAGAACCTGAGA<br>GCCGAGGACACGGCTGAGTATTACTGTGTGCGAGGAG<br>TCCTACCAGGTGGTACTGGGGGGGCTGGTTCGACTC<br>CTGGGGCCAGGGAACCCTGGTCACCGTCTCCTCA |
| 263 | 4194 | 498 | QVQLVESGGGLVKPGGSLRLSCAASGFTFSSFGMHWVR<br>QAPGQGLEWVASITGGSSYINYADSVKGRFTISRDNAKK<br>SLSLQMKNLRAEDTAEYYCVRGVLPGGTGGGWFDSWG<br>QGTLVTVSS |
| 263 | 4195 | 499 | FTFSSFGMH |
| 263 | 4196 | 500 | TTCACCTTCAGTAGTTTTGGCATGCAT |
| 263 | 4197 | 501 | SITGGSSYINYADSVKG |

TABLE 6-continued

Informal Sequence Listing

| Antibody No. | Seq. Ref. No. | SEQ ID NO. | Sequence |
|---|---|---|---|
| 263 | 4198 | 502 | TCCATTACTGGTGGCAGCAGTTACATAAACTACGCAGACTCAGTGAAGGGC |
| 263 | 4199 | 503 | VRGVLPGGTGGGWFDS |
| 263 | 4200 | 504 | GTGCGAGGAGTCCTACCAGGTGGTACTGGGGGGGGCTGGTTCGACTCC |
| 263 | 4201 | 505 | CAGTCTGTCCTGACTCAGCCGCCCTCAATGTCTGGGGCCCCAGGGCAGAGGGTCACCATCTCCTGCACTGGGACCAGCTCCAACATCGGGGCGGGTTATGATGTACAGTGGTATCAGCAGTTTCCAGGAACAGCCCCCAAACTCCTCATCTCTGGTAACAACAATCGGCCCTCAGGGGTCCCTGACCGATTCTCTGGCTCCAAGTCTGGCGCCTCAGCCTCCCTGGCCATCACTGGGCTCCAGGCTGAGGATGAGGCTGATTATTACTGCCAGTCCTATGACTACAGCCTGAATTGGGTGTTCGGCGGAGGGACCAAGCTCACCGTCCTA |
| 263 | 4202 | 506 | QSVLTQPPSMSGAPGQRVTISCTGTSSNIGAGYDVQWYQQFPGTAPKLLISGNNNRPSGVPDRFSGSKSGASASLAITGLQAEDEADYYCQSYDYSLNWVFGGGTKLTVL |
| 263 | 4203 | 507 | TGTSSNIGAGYDVQ |
| 263 | 4204 | 508 | ACTGGGACCAGCTCCAACATCGGGGCGGGTTATGATGTACAG |
| 263 | 4205 | 509 | GNNNRPS |
| 263 | 4206 | 510 | GGTAACAACAATCGGCCCTCA |
| 263 | 4207 | 511 | QSYDYSLNWV |
| 263 | 4208 | 512 | CAGTCCTATGACTACAGCCTGAATTGGGTG |
| 264 | 4209 | 513 | CAGGTGCAGCTGCAGGAGTCGGGCCCAGGACTGGTGAAGCCTTCACAGACCCTGTCGCTCACCTGCACTGTCTCTGGTCGCTTCCTCAATAGTGGTGATTACTACTGGAGTTGGATCCGCCAGTCCCCAGGGAAGGGCCTGGAGTGGCTTGGTTACATCCATCACAGTGGGAACACCTACTACAACCCGTCCCTCAAGAGTCGACTTACCATATCACTAGACATGTCCAAGAACCAGTTCTCCCTGAAGTTGAGCTCTGTGACAGCCGCAGACACGGCCGTCTATTACTGTGCCAGAGATTTGGGAAAGCCGCTTTGGGACGGCCACTATTACTACGGAGTGGACGTCTGGGGCCAAGGGACCACGGTCACCGTCTCCTCA |
| 264 | 4210 | 514 | QVQLQESGPGLVKPSQTLSLTCTVSGRFLNSGDYYWSWIRQSPGKGLEWLGYIHHSGNTYYNPSLKSRLTISLDMSKNQFSLKLSSVTAADTAVYYCARDLGKPLWDGHYYYGVDVWGQGTTVTVSS |
| 264 | 4211 | 515 | RFLNSGDYYWS |
| 264 | 4212 | 516 | CGCTTCCTCAATAGTGGTGATTACTACTGGAGT |
| 264 | 4213 | 517 | YIHHSGNTYYNPSLKS |
| 264 | 4214 | 518 | TACATCCATCACAGTGGGAACACCTACTACAACCCGTCCCTCAAGAGT |
| 264 | 4215 | 519 | ARDLGKPLWDGHYYYGVDV |
| 264 | 4216 | 520 | GCCAGAGATTTGGGAAAGCCGCTTTGGGACGGCCACTATTACTACGGAGTGGACGTC |
| 264 | 4217 | 521 | GATATTGTGATGACTCAGTCTCCAGGCACTCTGTCTTTGTCTCCAGGAGAAAGAGCCACCCTCTCCTGCAGGACCAGTCAGAATGTTAACAGCAACTACTTAGCCTGGTACCAGCATAAACCTGGGCAGGCTCCCAGGCTCCTCATCTATGGTGCATCCAGCAGGGTCACTGGCATCCCAGACAGGTTCAGTGGCAGTGGGTCTGGGACAGACTTCACTCTCACCATCACCAGAGTGGAGTCTGAAGATTTTGCAGTGTATTACTGTCAGGTGTATAGTAGTTCACCTCCGATCACCTTCGGCCAGGGGACCAAGGTGGAGATCAAA |

TABLE 6-continued

Informal Sequence Listing

| Antibody No. | Seq. Ref. No. | SEQ ID NO. | Sequence |
|---|---|---|---|
| 264 | 4218 | 522 | DIVMTQSPGTLSLSPGERATLSCRTSQNVSNYLAWYQH KPGQAPRLLIYGASSRVTGIPDRFSGSGSGTDFTLTITRVE SEDFAVYYCQVYSSSPPITFGQGTKVEIK |
| 264 | 4219 | 523 | RTSQNVSNYLA |
| 264 | 4220 | 524 | AGGACCAGTCAGAATGTTAACAGCAACTACTTAGCC |
| 264 | 4221 | 525 | GASSRVT |
| 264 | 4222 | 526 | GGTGCATCCAGCAGGGTCACT |
| 264 | 4223 | 527 | QVYSSSPPIT |
| 264 | 4224 | 528 | CAGGTGTATAGTAGTTCACCTCCGATCACC |
| 265 | 4225 | 529 | CAGGTCCAGCTTGTGCAGTCTGGGGCTGAGGTGAAGA AGCCTGGGTCCTCGGTGAAGGTCTCCTGCAAGGCTTC TGGAGGCACCTTCAGCAGTTATGCTATCAGCTGGGTG CGTCAGGCCCCAGGACAAGGGCTTGAGTGGATGGGA GGAATCATCCCTATGTTTGATATAGTCGACTACGCAC AGAAGTTCCAGGGCAGAGTCACGATTACCGCGGACGA ATCCACGAACACAGCCTACATGGAGCTGACCAGCCTG AGATCTGAGGACACGGCCGTGTATTACTGTGCGAGAA CTGCGGCTTTAGGACCACCTGGGACTATAGTGGGGTA CATGGACGTCTGGGGCAAAGGGACCACGGTCACCGTC TCCTCA |
| 265 | 4226 | 530 | QVQLVQSGAEVKKPGSSVKVSCKASGGTFSSYAISWVR QAPGQGLEWMGGIIPMFDIVDYAQKFQGRVTITADESTN TAYMELTSLRSEDTAVYYCARTAALGPPGTIVGYMDVW GKGTTVTVSS |
| 265 | 4227 | 531 | GTFSSYAIS |
| 265 | 4228 | 532 | GGCACCTTCAGCAGTTATGCTATCAGC |
| 265 | 4229 | 533 | GIIPMFDIVDYAQKFQG |
| 265 | 4230 | 534 | GGAATCATCCCTATGTTTGATATAGTCGACTACGCAC AGAAGTTCCAGGGC |
| 265 | 4231 | 535 | ARTAALGPPGTIVGYMDV |
| 265 | 4232 | 536 | GCGAGAACTGCGGCTTTAGGACCACCTGGGACTATAG TGGGGTACATGGACGTC |
| 265 | 4233 | 537 | GATATTGTGATGACGCAGTCTCCACTCTCCCTGCCCGT CACCCCTGGAGAGCCGGCCTCCATCTCCTGCCGGTCT AGTCAGAGCCTCCTGCAAAGTAATGGATACAACTATT TGGATTGGTACCTGCAGAAGCCAGGGCAGGCTCCACA GCTCCTGATCTATTTGGGTTCTAATCGGGCCTCCGGGG TCCCTGACAAGTTCAGTGGCAGTGGATCAGGCACAGA TTTTACACTGAAAATCAGCAGAGTGGAGGCTGAGGAT GTTGGGGTTTATTACTGCATGCAAACTCTACAAACTCC GTGGACGTTCGGCCAAGGGACCAAGGTGGAAATCAA A |
| 265 | 4234 | 538 | DIVMTQSPLSLPVTPGEPASISCRSSQSLLQSNGYNYLDW YLQKPGQAPQLLIYLGSNRASGVPDKFSGSGSGTDFTLKI SRVEAEDVGVYYCMQTLQTPWTFGQGTKVEIK |
| 265 | 4235 | 539 | RSSQSLLQSNGYNYLD |
| 265 | 4236 | 540 | CGGTCTAGTCAGAGCCTCCTGCAAAGTAATGGATACA ACTATTTGGAT |
| 265 | 4237 | 541 | LGSNRAS |
| 265 | 4238 | 542 | TTGGGTTCTAATCGGGCCTCC |
| 265 | 4239 | 543 | MQTLQTPWT |
| 265 | 4240 | 544 | ATGCAAACTCTACAAACTCCGTGGACG |

TABLE 6-continued

Informal Sequence Listing

| Antibody No. | Seq. Ref. No. | SEQ ID NO. | Sequence |
|---|---|---|---|
| 266 | 4241 | 545 | CAGGTGCAGCTGGTGGAGTCTGGAGCAGAGGCGAGA AAGCCCGGGGAGTCTCTGAAGATCTCCTGTAAGGCTT CTGGATACAGCTTTACCAATTATTGGATCGGCTGGGT GCGCCAGATGCCCGGGAAAGGCCTGGAGTGGATGGG GGTCATCTATCCTGCTGACTCCGATACCAGATATAGCC CGTCCTTCAAAGGCCAGGTCACCATCTCAGCCGACAA ATCCATCAGCACCGCCTACCTCCAGTGGACCAGACTG AAGGCCTCGGACACCGCCGTGTATTTCTGTGCGAGAC TTGGAATAGGAGCTGCTGCCCGGAACTACTGGGGCCA GGGAACCCTGGTCACCGTCTCTTCA |
| 266 | 4242 | 546 | QVQLVESGAEARKPGESLKISCKASGYSFTNYWIGWVR QMPGKGLEWMGVIYPADSDTRYSPSFKGQVTISADKSIS TAYLQWTRLKASDTAVYFCARLGIGAAARNYWGQGTL VTVSS |
| 266 | 4243 | 547 | YSFTNYWIG |
| 266 | 4244 | 548 | TACAGCTTTACCAATTATTGGATCGGC |
| 266 | 4245 | 549 | VIYPADSDTRYSPSFKG |
| 266 | 4246 | 550 | GTCATCTATCCTGCTGACTCCGATACCAGATATAGCCC GTCCTTCAAAGGC |
| 266 | 4247 | 551 | ARLGIGAAARNY |
| 266 | 4248 | 552 | GCGAGACTTGGAATAGGAGCTGCTGCCCGGAACTAC |
| 266 | 4249 | 553 | GACATCCAGGTGACCCAGTCTCCATCCTCCCTGTCTGC ATCTGTAGGAGACAGAGTCACCATCACTTGCCAGGCG AGTCAGGACATTAGCGACAGTTTAAATTGGTATCAGC AGAAACCAGGGAAAGCCCCTAACCTCCTGATCTACGA TGCATCCAAGTCGGAAACAGGGGTCCCATCAAGATTC AGTGGAAGCGGATCTGGGACAGATTTCACTTTCACCA TCAGTAGCCTGCAGCCTGAAGATCTTGCAACATATTA CTGTCTACAGTTTGATAATCTCCCTCCGACCTTCGGCC AAGGGACACGACTGGAGATTAAA |
| 266 | 4250 | 554 | DIQVTQSPSSLSASVGDRVTITCQASQDISDSLNWYQQKP GKAPNLLIYDASKSETGVPSRFSGSGSGTDFTFTISSLQPE DLATYYCLQFDNLPPTFGQGTRLEIK |
| 266 | 4251 | 555 | QASQDISDSLN |
| 266 | 4252 | 556 | CAGGCGAGTCAGGACATTAGCGACAGTTTAAAT |
| 266 | 4253 | 557 | DASKSET |
| 266 | 4254 | 558 | GATGCATCCAAGTCGGAAACA |
| 266 | 4255 | 559 | LQFDNLPPT |
| 266 | 4256 | 560 | CTACAGTTTGATAATCTCCCTCCGACC |
| 267 | 4257 | 561 | GAGGTGCAGCTGGTGGAGTCTGGGGGAGGCCTGGTCA AGCCTGGGGGGGCCCTGAGACTCTCCTGTGCAGCCTC TGGATTCAGCTTCAGGAGCTATAGCATGAACTGGGTC CGCCAGGCTCCAGGGAAGGGGCTGGAGTGGGTCTCAT CCATTAGTAGTAGTAGTAATTACATAAACTACGCAGA CTCAGTGAAGGGCCGATTCAGCATCTCCAGAGACAAC GCCAAGAACTCACTGTATCTGCAAATGAACAGCCTGA GAGCCGAGGACACGGCTGTCTATTACTGTGCGAGAGA TTTGTTACCCGTCGAGCGGGGTCCCGCTTTTGATATCT GGGGCCAAGGGACAATGGTCACCGTCTCTTCA |
| 267 | 4258 | 562 | EVQLVESGGGLVKPGGALRLSCAASGFSFRSYSMNWVR QAPGKGLEWVSSISSSSNYINYADSVKGRFSISRDNAKNS LYLQMNSLRAEDTAVYYCARDLLPVERGPAFDIWGQGT MVTVSS |
| 267 | 4259 | 563 | FSFRSYSMN |
| 267 | 4260 | 564 | TTCAGCTTCAGGAGCTATAGCATGAAC |

TABLE 6-continued

Informal Sequence Listing

| Antibody No. | Seq. Ref. No. | SEQ ID NO. | Sequence |
|---|---|---|---|
| 267 | 4261 | 565 | SISSSSNYINYADSVKG |
| 267 | 4262 | 566 | TCCATTAGTAGTAGTAGTAATTACATAAACTACGCAG ACTCAGTGAAGGGC |
| 267 | 4263 | 567 | ARDLLPVERGPAFDI |
| 267 | 4264 | 568 | GCGAGAGATTTGTTACCCGTCGAGCGGGGTCCCGCTT TTGATATC |
| 267 | 4265 | 569 | TCCTATGAGCTGACACAGCCACCCTCAGTGTCTGGGG CCCCAGGGCAGAGGGTCACCATCTCCTGCACTGGGAG CAGCTCCAACATCGGGGCAGGTTATGATGTACACTGG TTCCAGCAGCTTCCAGGAGCAGCCCCCAAACTCCTCA TCTATGCTAACAGCAATCGGCCCTCAGGGGTCCCTGA CCGATTCTCTGGCTCCAAGTCTGGCACCTCAGCCTCC TGGCCATCACTGGGCTCCAGGCTGAGGATGAGGCTGA TTATTACTGCCAGTCCTATGACAGCAGACTGGGTGGTT CGGTATTCGGCGGAGGGACCAAGGTGACCGTCCTA |
| 267 | 4266 | 570 | SYELTQPPSVSGAPGQRVTISCTGSSSNIGAGYDVHWFQ QLPGAAPKLLIYANSNRPSGVPDRFSGSKSGTSASLAITG LQAEDEADYYCQSYDSRLGGSVFGGGTKVTVL |
| 267 | 4267 | 571 | TGSSSNIGAGYDVH |
| 267 | 4268 | 572 | ACTGGGAGCAGCTCCAACATCGGGGCAGGTTATGATG TACAC |
| 267 | 4269 | 573 | ANSNRPS |
| 267 | 4270 | 574 | GCTAACAGCAATCGGCCCTCA |
| 267 | 4271 | 575 | QSYDSRLGGSV |
| 267 | 4272 | 576 | CAGTCCTATGACAGCAGACTGGGTGGTTCGGTA |
| 268 | 4273 | 577 | CAGGTCCAGCTTGTGCAGTCTGGACCAGAGGTGAAAA AGCCCGGGGAGTCTCTGACGATCTCCTGTAAGGGTTC TGGATACGACTTTTCCAATAACTGGATCGGCTGGGTG CGCCAGATGCCCGGGAAAGGCCTGGAGTGGATGGGA ATCATCTATCCTGGTGACTCTGATACCAGATACAGCCC GTCGTTCCAAGGCCAGGTCACCCTCTCAGTCGACAAG TCCATTAGTACCGCCTACCTACAGTGGAGGAGCCTGA AGGCCTCGGACAGCGGCATCTACTACTGTGCGAGACA AATTGGCGGTTTGGTTTGTAGCAGTGAGAGCTGCTAC TTCTACGGCATGGACGTCTGGGGCCAAGGGACCACGG TCACCGTCTCCTCA |
| 268 | 4274 | 578 | QVQLVQSGPEVKKPGESLTISCKGSGYDFSNNWIGWVR QMPGKGLEWMGIIYPGDSDTRYSPSFQGQVTLSVDKSIS TAYLQWRSLKASDSGIYYCARQIGGLVCSSESCYFYGM DVWGQGTTVTVSS |
| 268 | 4275 | 579 | YDFSNNWIG |
| 268 | 4276 | 580 | TACGACTTTTCCAATAACTGGATCGGC |
| 268 | 4277 | 581 | IIYPGDSDTRYSPSFQG |
| 268 | 4278 | 582 | ATCATCTATCCTGGTGACTCTGATACCAGATACAGCCC GTCGTTCCAAGGC |
| 268 | 4279 | 583 | ARQIGGLVCSSESCYFYGMDV |
| 268 | 4280 | 584 | GCGAGACAAATTGGCGGTTTGGTTTGTAGCAGTGAGA GCTGCTACTTCTACGGCATGGACGTC |
| 268 | 4281 | 585 | GACATCCAGTTGACCCAGTCTCCATCCTCCCTGTCTGC ATCTGTGGGAGGCAGAGTGACCATCACTTGCCGGGCA AGTCAGAGCATTAGCAACTATTTAAATTGGTATCAAC ACAAACCGGGGAAAGCCCCTGAACTCCTGATCTATGG TGCATCCAGTTTGCAAAGTGGGGTCCCATCAAGGTTC AGTGGCAGTGGATCTGGGACAGACTTCACTCTCACCA TCAGCAGTCTGCAACCTGAAGATTTTGCAACTTACTAC |

TABLE 6-continued

Informal Sequence Listing

| Antibody No. | Seq. Ref. No. | SEQ ID NO. | Sequence |
|---|---|---|---|
| | | | TGTCAACAGAGTGACACTACCCCGTTCACTTTCGGCC<br>AGGGGACCAAAGTGGATATCAAA |
| 268 | 4282 | 586 | DIQLTQSPSSLSASVGGRVTITCRASQSISNYLNWYQHKP<br>GKAPELLIYGASSLQSGVPSRFSGSGSGTDFTLTISSLQPE<br>DFATYYCQQSDTTPFTFGQGTKVDIK |
| 268 | 4283 | 587 | RASQSISNYLN |
| 268 | 4284 | 588 | CGGGCAAGTCAGAGCATTAGCAACTATTTAAAT |
| 268 | 4285 | 589 | GASSLQS |
| 268 | 4286 | 590 | GGTGCATCCAGTTTGCAAAGT |
| 268 | 4287 | 591 | QQSDTTPFT |
| 268 | 4288 | 592 | CAACAGAGTGACACTACCCCGTTCACT |
| 269 | 4289 | 593 | CAGGTCCAGCTGGTGCAGTCTGGGGGAGGCTTGGTAA<br>AGCCGGGGGGGTCCCTTAGACTCTCCTGTGCAGCCTC<br>TGGATTCACTTTCAGTAAGGCCTGGATGAACTGGGTC<br>CGCCAGGCTCCAGGGAAGGGGCTGGAGTGGGTTGGCC<br>GTATTAGAAGCAAAACTGATGGTGGGACAGCAGACTA<br>CGCGGCACCCGTGAAAGGCAGATTCACCATGTCAAGA<br>GATGATTCAAAAAACACGCTGTATTTGCAAATGAACA<br>GCCTGAAAACCGAGGACACAGCCGTGTATTACTGTGC<br>CACAGATTCTCGCCGACTCTATGATAGTCGTGGTTTTT<br>ATTCAAGTGCTTTTGATGTCTGGGGCCAAGGGACCAC<br>GGTCACCGTCTCCTCA |
| 269 | 4290 | 594 | QVQLVQSGGGLVKPGGSLRLSCAASGFTFSKAWMNWV<br>RQAPGKGLEWVGRIRSKTDGGTADYAAPVKGRFTMSR<br>DDSKNTLYLQMNSLKTEDTAVYYCATDSRRLYDSRGFY<br>SSAFDVWGQGTTVTVSS |
| 269 | 4291 | 595 | FTFSKAWMN |
| 269 | 4292 | 596 | TTCACTTTCAGTAAGGCCTGGATGAAC |
| 269 | 4293 | 597 | RIRSKTDGGTADYAAPVKG |
| 269 | 4294 | 598 | CGTATTAGAAGCAAAACTGATGGTGGGACAGCAGACT<br>ACGCGGCACCCGTGAAAGGC |
| 269 | 4295 | 599 | ATDSRRLYDSRGFYSSAFDV |
| 269 | 4296 | 600 | GCCACAGATTCTCGCCGACTCTATGATAGTCGTGGTTT<br>TTATTCAAGTGCTTTTGATGTC |
| 269 | 4297 | 601 | CAGTCTGTCCTGACGCAGCCGCCCTCAGTGTCTGGGG<br>CCCCAGGGCAGAGGGTCACCATCTCCTGCACTGGGAG<br>CAGCTCCAACATCGGGGCGGTTATGATGTACACTGG<br>TACCAACACCTTCCAGGAACAGCCCCCAAAGTCCTCA<br>TCTATGGTAACAACAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACGACAGCCTGACTGGTT<br>GGGTGTTCGGCGGAGGGACCAAGGTCACCGTCCTA |
| 269 | 4298 | 602 | QSVLTQPPSVSGAPGQRVTISCTGSSSNIGAGYDVHWYQ<br>HLPGTAPKVLIYGNNNRPSGVPDRFSGSKSGTSASLAITG<br>LQAEDEADYYCQSYDDSLTGWVFGGGTKVTVL |
| 269 | 4299 | 603 | TGSSSNIGAGYDVH |
| 269 | 4300 | 604 | ACTGGGAGCAGCTCCAACATCGGGGCGGGTTATGATG<br>TACAC |
| 269 | 4301 | 605 | GNNNRPS |
| 269 | 4302 | 606 | GGTAACAACAATCGGCCCTCA |
| 269 | 4303 | 607 | QSYDDSLTGWV |

US 11,485,775 B2

TABLE 6-continued

Informal Sequence Listing

| Antibody No. | Seq. Ref. No. | SEQ ID NO. | Sequence |
|---|---|---|---|
| 269 | 4304 | 608 | CAGTCCTATGACGACAGCCTGACTGGTTGGGTG |
| 270 | 4305 | 609 | CAGGTGCAGCTGGTGCAATCTGGACCAGAGGTGAAAA AGCCCGGGGAGTCTCTGACGATCTCCTGTAAGGGTTC TGGATACGACTTTTCCAATAACTGGATCGGCTGGGTG CGCCAGATGCCCGGGAAAGGCCTGGAGTGGATGGGA ATCATCTATCCTGGTGACTCTGATACCAGATACAGCCC GTCGTTCCAAGGCCAGGTCACCCTCTCAGTCGACAAG TCCATTAGTACCGCCTACCTACAGTGGAGGAGCCTGA AGGCCTCGGACAGCGGCATCTACTACTGTGCGAGACA AATTGGCGGTTTGGTTTGTAGCAGTGAGAGCTGCTAC TTCTACGGCATGGACGTCTGGGGCCAAGGGACCACGG TCACCGTCTCCTCA |
| 270 | 4306 | 610 | QVQLVQSGPEVKKPGESLTISCKGSGYDFSNNWIGWVR QMPGKGLEWMGIIYPGDSDTRYSPSFQGQVTLSVDKSIS TAYLQWRSLKASDSGIYYCARQIGGLVCSSESCYFYGM DVWGQGTTVTVSS |
| 270 | 4307 | 611 | YDFSNNWIG |
| 270 | 4308 | 612 | TACGACTTTTCCAATAACTGGATCGGC |
| 270 | 4309 | 613 | IIYPGDSDTRYSPSFQG |
| 270 | 4310 | 614 | ATCATCTATCCTGGTGACTCTGATACCAGATACAGCCC GTCGTTCCAAGGC |
| 270 | 4311 | 615 | ARQIGGLVCSSESCYFYGMDV |
| 270 | 4312 | 616 | GCGAGACAAATTGGCGGTTTGGTTTGTAGCAGTGAGA GCTGCTACTTCTACGGCATGGACGTC |
| 270 | 4313 | 617 | GACATCCGGGTGACCCAGTCTCCATCCTCCCTGTCTGC ATCTGTGGGAGGCAGAGTGACCATCACTTGCCGGGCA AGTCAGAGCATTAGCAACTATTTAAATTGGTATCAAC ACAAACCGGGGAAAGCCCCTGAACTCCTGATCTATGG TGCATCCAGTTTGCAAAGTGGGGTCCCATCAAGGTTC AGTGGCAGTGGATCTGGGACAGACTTCACTCTCACCA TCAGCAGTCTGCAACCTGAAGATTTTGCAACTTACTAC TGTCAACAGAGTGACACTACCCCGTTCACTTTCGGCC AGGGGACCAAGCTGGAGATCAAA |
| 270 | 4314 | 618 | DIRVTQSPSSLSASVGGRVTITCRASQSISNYLNWYQHKP GKAPELLIYGASSLQSGVPSRFSGSGSGTDFTLTISSLQPE DFATYYCQQSDTTPFTFGQGTKLEIK |
| 270 | 4315 | 619 | RASQSISNYLN |
| 270 | 4316 | 620 | CGGGCAAGTCAGAGCATTAGCAACTATTTAAAT |
| 270 | 4317 | 621 | GASSLQS |
| 270 | 4318 | 622 | GGTGCATCCAGTTTGCAAAGT |
| 270 | 4319 | 623 | QQSDTTPFT |
| 270 | 4320 | 624 | CAACAGAGTGACACTACCCCGTTCACT |
| 271 | 4321 | 625 | GAGGTGCAGCTGGTGGAGTCTGGGGGAGGCCTGGTCA AGCCTGGGGGGTCCCTGAGACTCTCTTGTGCAGCCTCT GGATTCACCTTCAGTAGTTTTGGCATGCATTGGGTCCG CCAGGCTCCAGGGCAGGGACTGGAGTGGGTCGCATCC ATTACTGGTGGCAGCAGTTACATAAACTACGCAGACT CAGTGAAGGGCCGATTCACCATCTCCAGAGACAACGC CAAGAAGTCACTGTCTCTGCAAATGAAGAACCTGAGA GCCGAGGACACGGCTGAGTATTACTGTGTGCGAGGAG TCCTACCAGGTGATACTGGGGGGGCTGGTTCGACTC CTGGGGCCAGGGAACCCTGGTCACCGTCTCCTCA |
| 271 | 4322 | 626 | EVQLVESGGGLVKPGGSLRLSCAASGFTFSSFGMHWVR QAPGQGLEWVASITGGSSYINYADSVKGRFTISRDNAKK SLSLQMKNLRAEDTAEYYCVRGVLPGDTGGGWFDSWG QGTLVTVSS |

TABLE 6-continued

Informal Sequence Listing

| Antibody No. | Seq. Ref. No. | SEQ ID NO. | Sequence |
|---|---|---|---|
| 271 | 4323 | 627 | FTFSSFGMH |
| 271 | 4324 | 628 | TTCACCTTCAGTAGTTTTGGCATGCAT |
| 271 | 4325 | 629 | SITGGSSYINYADSVKG |
| 271 | 4326 | 630 | TCCATTACTGGTGGCAGCAGTTACATAAACTACGCAGACTCAGTGAAGGGC |
| 271 | 4327 | 631 | VRGVLPGDTGGGWFDS |
| 271 | 4328 | 632 | GTGCGAGGAGTCCTACCAGGTGATACTGGGGGGGGCTGGTTCGACTCC |
| 271 | 4329 | 633 | CAGTCTGTGCTGACGCAGCCGCCCTCAATGTCTGGGGCCCCAGGGCAGAGGGTCACCATCTCCTGCACTGGGACCAGCTCCAACATCGGGGCGGGTTATGATGTACAGTGGTATCAGCAGTTTCCAGGAACAGCCCCCAAACTCCTCATCTCTGGTAACAACAATCGGCCCTCAGGGGTCCCTGACCGATTCTCTGGCTCCAAGTCTGGCGCCTCAGCCTCCCTGGCCATCACTGGGCTCCAGGCTGAGGATGAGGCTGATTATTACTGCCAGTCCTATGACTACAGCCTGAATTGGGTGTTCGGCGGAGGGACCAAGCTGACCGTCCTA |
| 271 | 4330 | 634 | QSVLTQPPSMSGAPGQRVTISCTGTSSNIGAGYDVQWYQQFPGTAPKLLISGNNNRPSGVPDRFSGSKSGASASLAITGLQAEDEADYYCQSYDYSLNWVFGGGTKLTVL |
| 271 | 4331 | 635 | TGTSSNIGAGYDVQ |
| 271 | 4332 | 636 | ACTGGGACCAGCTCCAACATCGGGGCGGGTTATGATGTACAG |
| 271 | 4333 | 637 | GNNNRPS |
| 271 | 4334 | 638 | GGTAACAACAATCGGCCCTCA |
| 271 | 4335 | 639 | QSYDYSLNWV |
| 271 | 4336 | 640 | CAGTCCTATGACTACAGCCTGAATTGGGTG |
| 272 | 4337 | 641 | CAGGTCCAGCTTGTACAGTCTGGAGCAGAGGTGAAAAAGCCCGGGGAGTCTCTGAAGATCTCCTGTAAGGGTTCTGGATACAGCTTTAGCAGTTTCTGGATCGGCTGGGTGCGCCAGATGCCCGGGAAAGGCCTGGAGTGGATGGGGATCATATATCCTGGTGACTCTGATACCAGATATAGCCCGTCTTTCCAAGGCCAGGTCACCATGTCAGCCGACACGTCCATAAACACCGCCTACCTGCAGTGGAACAGCGTGAAGGCCTCGGACACCGCCATTTATTACTGTGCGAGACTTCCAGTTGGTAGTTATTATTACTTCAATCTCTGGGGCCGTGGCACCCTGGTCACCGTCTCCTCA |
| 272 | 4338 | 642 | QVQLVQSGAEVKKPGESLKISCKGSGYSFSSFWIGWVRQMPGKGLEWMGIIYPGDSDTRYSPSFQGQVTMSADTSINTAYLQWNSVKASDTAIYYCARLPVGSYYYFNLWGRGTLVTVSS |
| 272 | 4339 | 643 | YSFSSFWIG |
| 272 | 4340 | 644 | TACAGCTTTAGCAGTTTCTGGATCGGC |
| 272 | 4341 | 645 | IIYPGDSDTRYSPSFQG |
| 272 | 4342 | 646 | ATCATATATCCTGGTGACTCTGATACCAGATATAGCCCGTCTTTCCAAGGC |
| 272 | 4343 | 647 | ARLPVGSYYYFNL |
| 272 | 4344 | 648 | GCGAGACTTCCAGTTGGTAGTTATTATTACTTCAATCTC |
| 272 | 4345 | 649 | GAAATTGTGATGACACAGTCTCCAGCCACCCTGTCTGTGTCTCCAGGGGAAAGCGCCACCCTATTTTGCAGGGCCAGTCAGAGTATTAGTAGCGACTTAGCCTGGTACCAGCAGAGACCTGGCCAGGCTCCCAGGCTCCTCATCTATG |

TABLE 6-continued

Informal Sequence Listing

| Antibody No. | Seq. Ref. No. | SEQ ID NO. | Sequence |
|---|---|---|---|
| | | | ATGCATCCACCAGGGCCACTGGTGTCCCTGCCAGGTT CAGTGCCACTGGGTCTGAGGCAGAGTTCACTCTCACC ATCAGCGGCCTGCAGTCTGAAGATTTTGCAGTTTATTA CTGTCAGCAGTATAATAACTGGCTTTCGTGGACGTTCG GCCAAGGGACCAAGCTGGAGATCAAA |
| 272 | 4346 | 650 | EIVMTQSPATLSVSPGESATLFCRASQSISSDLAWYQQRP GQAPRLLIYDASTRATGVPARFSATGSEAEFTLTISGLQS EDFAVYYCQQYNNWLSWTFGQGTKLEIK |
| 272 | 4347 | 651 | RASQSISSDLA |
| 272 | 4348 | 652 | AGGGCCAGTCAGAGTATTAGTAGCGACTTAGCC |
| 272 | 4349 | 653 | DASTRAT |
| 272 | 4350 | 654 | GATGCATCCACCAGGGCCACT |
| 272 | 4351 | 655 | QQYNNWLSWT |
| 272 | 4352 | 656 | CAGCAGTATAATAACTGGCTTTCGTGGACG |
| 273 | 4353 | 657 | CAGGTGCAGCTGCAGGAGTCGGGCCCAGGACTGGAG AAGCCTTCACAGACCCTGTCCCTCACCTGCACTGTCTC TCGTGGCTCCATCAGAATTGGTGGTTACTTCTGGAGTT GGATCCGCCAGCACCCAGGGAAGGGTCTGGAGTGGCT TGGATACATCTCTAACGATGGGGCCACCGACTACAAC CCGTCCCTCAGGAGTCGACTTGCCATATCAGCAGACA CATCTAAGAACCAGTTTTCCCTGACCCTGAGGTCTGTG ACTGCCGCGGACACGGCCATCTATTACTGTGCGAGAA CTTCTTATGCAGGGCGCATGCTCGACCGCTGGGGCCA GGGAATCCTGGTCACCGTCTCCTCA |
| 273 | 4354 | 658 | QVQLQESGPGLEKPSQTLSLTCTVSRGSIRIGGYFWSWIR QHPGKGLEWLGYISNDGATDYNPSLRSRLAISADTSKNQ FSLTLRSVTAADTAIYYCARTSYAGRMLDRWGQGILVT VSS |
| 273 | 4355 | 659 | GSIRIGGYFWS |
| 273 | 4356 | 660 | GGCTCCATCAGAATTGGTGGTTACTTCTGGAGT |
| 273 | 4357 | 661 | YISNDGATDYNPSLRS |
| 273 | 4358 | 662 | TACATCTCTAACGATGGGGCCACCGACTACAACCCGT CCCTCAGGAGT |
| 273 | 4359 | 663 | ARTSYAGRMLDR |
| 273 | 4360 | 664 | GCGAGAACTTCTTATGCAGGGCGCATGCTCGACCGC |
| 273 | 4361 | 665 | GACATCCGGGTGACCCAGTCTCCAGTCTCCCTGCCCGT CACCCCTGGAGAGCCGGCCTCCATCTCCTGCAGGTCT AGTCAGAGTCTCCTGCATAGTAATGGAAACAACTATT TGGATTGGTACCTGCAGAAGCCAGGGCAGTCTCCACA ACTCCTGATCTATATGGGTTCTTATCGGGCCTCCGGGG TCCCTGACAGGTTCAGCGGCAGTGGATCAGGCACAGA TTTTACACTGAAAATCAGCAGAGTGGAGGCTGAGGAT GTTGGTGTTTATTACTGCATGCAAGGTCTACAAATTCC TTGGACGTTCGGCCAAGGGACCAAGCTGGAGATCAAA |
| 273 | 4362 | 666 | DIRVTQSPVSLPVTPGEPASISCRSSQSLLHSNGNNYLDW YLQKPGQSPQLLIYMGSYRASGVPDRFSGSGSGTDFTLKI SRVEAEDVGVYYCMQGLQIPWTFGQGTKLEIK |
| 273 | 4363 | 667 | RSSQSLLHSNGNNYLD |
| 273 | 4364 | 668 | AGGTCTAGTCAGAGTCTCCTGCATAGTAATGGAAACA ACTATTTGGAT |
| 273 | 4365 | 669 | MGSYRAS |
| 273 | 4366 | 670 | ATGGGTTCTTATCGGGCCTCC |
| 273 | 4367 | 671 | MQGLQIPWT |

TABLE 6-continued

Informal Sequence Listing

| Antibody No. | Seq. Ref. No. | SEQ ID NO. | Sequence |
|---|---|---|---|
| 273 | 4368 | 672 | ATGCAAGGTCTACAAATTCCTTGGACG |
| 274 | 4369 | 673 | GAGGTGCAGCTGTTGGAGTCTGGGGGAGGCGTGGTCC AGCCTGGGAGGTCCCTCAGACTCTCCTGTGCAGCCTCT GGATTCACCTTCAGTAGCTATGCCATGCACTGGGTCC GCCAGACTCCAGACAAGGGGCTGGAGTGGGTGGCACT TATATCCGATGATGGAAGAAATGAATATTATGCAGAT TCCGTGCAGGGCCGATTCACCATCTCCAGAGACAAAT CCAAGAACACGCTGCATCTGGAAATGAACAGCCTGAG AGCTGAGGACACGGCTGTTTATTACTGTGCGAAAGTA CGAAATGAGGCGTGGGAGCTCCTGGGTAATGATGATG CTCTTGATGTCTGGGGCCAAGGGACAATGGTCACCGT CTCTTCA |
| 274 | 4370 | 674 | EVQLLESGGGVVQPGRSLRLSCAASGFTFSSYAMHWVR QTPDKGLEWVALISDDGRNEYYADSVQGRFTISRDKSK NTLHLEMNSLRAEDTAVYYCAKVRNEAWELLGNDDAL DVWGQGTMVTVSS |
| 274 | 4371 | 675 | FTFSSYAMH |
| 274 | 4372 | 676 | TTCACCTTCAGTAGCTATGCCATGCAC |
| 274 | 4373 | 677 | LISDDGRNEYYADSVQG |
| 274 | 4374 | 678 | CTTATATCCGATGATGGAAGAAATGAATATTATGCAG ATTCCGTGCAGGGC |
| 274 | 4375 | 679 | AKVRNEAWELLGNDDALDV |
| 274 | 4376 | 680 | GCGAAAGTACGAAATGAGGCGTGGGAGCTCCTGGGT AATGATGATGCTCTTGATGTC |
| 274 | 4377 | 681 | CAGTCTGTGCTGACGCAGCCGCCCTCAGTGTCTGCGG CCCCAGGACAGAAAGTCACCATCTCCTGCTCTGGAAC TAGCTTCAACATTGGCAGTAATTACGTATCCTGGTACC AGCTACTCCCAGGAACAGCCCCCAAACTCCTCATTTTT GACAATTATAAGCGACCCTCAGGGATTCCTGACCGAT TCTCTGGCTCCTGGTCTGGCACGTCAGCCACCCTGGCC ATCAGCGGACTCCAGACTGGGGACGAGGCCGAATACT TCTGCGGAACTTGGGACACCAGCCTGAGAGCTGGAGT GTTCGGCGGAGGGACCAAGCTCACCGTCCTA |
| 274 | 4378 | 682 | QSVLTQPPSVSAAPGQKVTISCSGTSFNIGSNYVSWYQLL PGTAPKLLIFDNYKRPSGIPDRFSGSWSGTSATLAISGLQT GDEAEYFCGTWDTSLRAGVFGGGTKLTVL |
| 274 | 4379 | 683 | SGTSFNIGSNYVS |
| 274 | 4380 | 684 | TCTGGAACTAGCTTCAACATTGGCAGTAATTACGTATC C |
| 274 | 4381 | 685 | DNYKRPS |
| 274 | 4382 | 686 | GACAATTATAAGCGACCCTCA |
| 274 | 4383 | 687 | GTWDTSLRAGV |
| 274 | 4384 | 688 | GGAACTTGGGACACCAGCCTGAGAGCTGGAGTG |
| 275 | 4385 | 689 | CAGGTCCAGCTGGTGCAGTCTGGGTCTGAGGTGAAGA AGCCTGGGGCCTCAGTGAGGCTCTCCTGCAAGGTTGC CGGTTACAGCCTCAGTGAGTTATCCATGCACTGGGTG CGACAGTCTCCTGGAAAAGGGCTTGAGTGGTTGGGAG CTTTTGACCATGAAGATGCTGAAGCAATCTATGCACC GAGGTTCCAGGGCAGAATCACCATGACCGCGGACACA TCTACGGACACAGCCTACATGGAACTGAGCAGCCTGA GATCTGAGGACACGGCCGTTTATTACTGTGCAACACC GACCCCAGTTGGAGCTACGGACTACTGGGGCCAGGGA ACCCTGGTCACCGTCTCCTCA |
| 275 | 4386 | 690 | QVQLVQSGSEVKKPGASVRLSCKVAGYSLSELSMHWVR QSPGKGLEWLGAFDHEDAEAIYAPRFQGRITMTADTSTD TAYMELSSLRSEDTAVYYCATPTPVGATDYWGQGTLVT VSS |

TABLE 6-continued

Informal Sequence Listing

| Antibody No. | Seq. Ref. No. | SEQ ID NO. | Sequence |
|---|---|---|---|
| 275 | 4387 | 691 | YSLSELSMH |
| 275 | 4388 | 692 | TACAGCCTCAGTGAGTTATCCATGCAC |
| 275 | 4389 | 693 | AFDHEDAEAIYAPRFQG |
| 275 | 4390 | 694 | GCTTTTGACCATGAAGATGCTGAAGCAATCTATGCAC CGAGGTTCCAGGGC |
| 275 | 4391 | 695 | ATPTPVGATDY |
| 275 | 4392 | 696 | GCAACACCGACCCCAGTTGGAGCTACGGACTAC |
| 275 | 4393 | 697 | GACATCCAGATGACCCAGTCTCCATCCTCCCTGTCTGC ATCTGTAGGAGACAGAGTCACCATCACTTGCCGGGCA AGTCAGAGTATTAGTAGTTATTTAAATTGGTATCAAC AAAAACCAGGAAAAGCCCCTAAGCTCCTGATCTATGC TGCATCCAGTTTGCAAAGGGGGGGCCCATCAAGATTC AGTGGCAGTGGATCTGGGACAGATTTCACTCTCACCA TCAGCAGTCTGCAACCTGAAGATTTTGCAACTTACTAT TGTCAACAGAGTTACATTATTCCGTACACTTTTGGCCA GGGGACCAAAGTGGATATCAAA |
| 275 | 4394 | 698 | DIQMTQSPSSLSASVGDRVTITCRASQSISSYLNWYQQKP GKAPKLLIYAASSLQRGGPSRFSGSGSGTDFTLTISSLQPE DFATYYCQQSYIIPYTFGQGTKVDIK |
| 275 | 4395 | 699 | RASQSISSYLN |
| 275 | 4396 | 700 | CGGGCAAGTCAGAGTATTAGTAGTTATTTAAAT |
| 275 | 4397 | 701 | AASSLQR |
| 275 | 4398 | 702 | GCTGCATCCAGTTTGCAAAGG |
| 275 | 4399 | 703 | QQSYIIPYT |
| 275 | 4400 | 704 | CAACAGAGTTACATTATTCCGTACACT |
| 276 | 4401 | 705 | CAGGTGCAGCTGCAGGAGTCCGGCCCAGGACGGGTG AAGCCTTCGGAGACCCTGTCCCTCACCTGCAGTGTCG CTGATGGCTCAATCAGTAGTGGTCATTACTACTGGGG CTGGGTCCGCCAGCCCCCAGGGAAGGGGCTGGAGTGG ATTGCGACAATCCATGATAGTGGGGCCACGTACTACA ACCCGTCCCTCCAGAGTCGAGTCACCATATCCGTAGA CACGTCCAAGAACCAGTTCTCCCTGAAAGTGAATTCT GTGACCGCCGCAGACACGGCTGTCTATTACTGTGCGA GTCGAAGGGGCAGTGGCTGGTTTTTCGACTCCTGGGG CCAGGGAACCCTGGTCACCGTCTCCTCA |
| 276 | 4402 | 706 | QVQLQESGPGRVKPSETLSLTCSVADGSISSGHYYWGW VRQPPGKGLEWIATIHDSGATYYNPSLQSRVTISVDTSK NQFSLKVNSVTAADTAVYYCASRRGSGWFFDSWGQGT LVTVSS |
| 276 | 4403 | 707 | GSISSGHYYWG |
| 276 | 4404 | 708 | GGCTCAATCAGTAGTGGTCATTACTACTGGGGC |
| 276 | 4405 | 709 | TIHDSGATYYNPSLQS |
| 276 | 4406 | 710 | ACAATCCATGATAGTGGGGCCACGTACTACAACCCGT CCCTCCAGAGT |
| 276 | 4407 | 711 | ASRRGSGWFFDS |
| 276 | 4408 | 712 | GCGAGTCGAAGGGGCAGTGGCTGGTTTTTCGACTCC |
| 276 | 4409 | 713 | GATATTGTGCTGACTCAGTCTCCAGCCACCCTGTCTGT GTCTCCAGGGGAAAGAGTCACCCTCTCCTGCAGGGCC AGTCACAGTGTTAACTACAATTTAGCCTGGTACCAGC AGAAACCTGGTCAGGCTCCCAGGCTCCTCATCTATGG TTCATCTACCAGGGCCACTGGTCTCCCAGCCAGGTTCA GTGGCAGTGGGTCTGGGACAGAGTTCACTCTCACCAT CAGCAGCCTGCAGTCTGAAGATTTTGCAATTTATTACT |

TABLE 6-continued

Informal Sequence Listing

| Antibody No. | Seq. Ref. No. | SEQ ID NO. | Sequence |
|---|---|---|---|
| | | | GTCAGCAGTATAATAACTGGCCTCCGGGAGGCACTTT TGGCCAGGGGACCAAGGTGGAAATCAAA |
| 276 | 4410 | 714 | DIVLTQSPATLSVSPGERVTLSCRASHSVNYNLAWYQQK PGQAPRLLIYGSSTRATGLPARFSGSGSGTEFTLTISSLQS EDFAIYYCQQYNNWPPGGTFGQGTKVEIK |
| 276 | 4411 | 715 | RASHSVNYNLA |
| 276 | 4412 | 716 | AGGGCCAGTCACAGTGTTAACTACAATTTAGCC |
| 276 | 4413 | 717 | GSSTRAT |
| 276 | 4414 | 718 | GGTTCATCTACCAGGGCCACT |
| 276 | 4415 | 719 | QQYNNWPPGGT |
| 276 | 4416 | 720 | CAGCAGTATAATAACTGGCCTCCGGGAGGCACT |
| 277 | 4417 | 721 | GAGGTGCAGCTGTTGGAGTCTGGGGGAGGCCTGGTCA AGCCTGGGGGGTCCCTGAGACTCTCCTGTGCAGCCTC TGGATTCACCTTCAGTAGCTATAGCATGAACTGGGTC CGCCAGGCTCCAGGGAAGGGGCTGGAGTGGGTCTCAT CCATTAGTAGTAGTAGTAGTTACATATACTACGCAGA CTCAGTGAAGGGCCGATTCACCATCTCCAGAGACAAC GCCAAGAACTCACTGTATCTGCAAATGAACAGCCTGA GAGCCGAGGACACGGCTGTGTATTACTGTGCGAGAGA TTGGCCGAATAGCAGCTCGTCGCCGAACTGGTTCGAC CCCTGGGGCCAGGGAACCCTGGTCACCGTCTCCTCA |
| 277 | 4418 | 722 | EVQLLESGGGLVKPGGSLRLSCAASGFTFSSYSMNWVR QAPGKGLEWVSSISSSSSYIYYADSVKGRFTISRDNAKNS LYLQMNSLRAEDTAVYYCARDWPNSSSSPNWFDPWGQ GTLVTVSS |
| 277 | 4419 | 723 | FTFSSYSMN |
| 277 | 4420 | 724 | TTCACCTTCAGTAGCTATAGCATGAAC |
| 277 | 4421 | 725 | SISSSSSYIYYADSVKG |
| 277 | 4422 | 726 | TCCATTAGTAGTAGTAGTAGTTACATATACTACGCAG ACTCAGTGAAGGGC |
| 277 | 4423 | 727 | ARDWPNSSSSPNWFDP |
| 277 | 4424 | 728 | GCGAGAGATTGGCCGAATAGCAGCTCGTCGCCGAACT GGTTCGACCCC |
| 277 | 4425 | 729 | CAGTCTGTCCTGACGCAGCCGCCCTCAGTGTCTGGGG CCCCAGGGCAGAGGGTCACCATCTCCTGCACTGGGAG CAGCTCCAACATCGGGGCAGGTTATGATGTACACTGG TACCAGCAGCTTCCAGGAACAGCCCCCAAACTCCTCA TCTATGGTAACAGCAATCGGCCCTCAGGGGTCCCTGA CCGATTCTCTGGCTCCAAGTCTGGCACCTCAGCCTCCC TGGCCATCACTGGGCTCCAGGCTGAGGATGAGGCTGA TTATTACTGCCAGTCCTATGACAGCAGCCTGAGTGGTT TTTATGTCTTCGGAACTGGGACCAAGCTCACCGTCCTA |
| 277 | 4426 | 730 | QSVLTQPPSVSGAPGQRVTISCTGSSSNIGAGYDVHWYQ QLPGTAPKLLIYGNSNRPSGVPDRFSGSKSGTSASLAITG LQAEDEADYYCQSYDSSLSGFYVFGTGTKLTVL |
| 277 | 4427 | 731 | TGSSSNIGAGYDVH |
| 277 | 4428 | 732 | ACTGGGAGCAGCTCCAACATCGGGGCAGGTTATGATG TACAC |
| 277 | 4429 | 733 | GNSNRPS |
| 277 | 4430 | 734 | GGTAACAGCAATCGGCCCTCA |
| 277 | 4431 | 735 | QSYDSSLSGFYV |
| 277 | 4432 | 736 | CAGTCCTATGACAGCAGCCTGAGTGGTTTTTATGTC |

TABLE 6-continued

Informal Sequence Listing

| Antibody No. | Seq. Ref. No. | SEQ ID NO. | Sequence |
|---|---|---|---|
| 278 | 4433 | 737 | CAGGTCCAGCTGGTACAGTCTGGGGCAGAGGTGAAAA AGCCCGGGGAGTCTCTGAAGATCTCCTGTCAGGGTTC TGGATACAGCTTTAGCAGTTTCTGGATCGTCTGGGTGC GCCAGATGCCCGGGAAAGGCCTGGAGTGGATGGGGA GCATCTATCCTGGTGACTCTGACACCAGATACACCCC GTCCTTCCAAGGCCAGGTCACCATCTCAGCCGACAAG TCCACCAGCACCGCCTATTTGCAGTGGAACAGCCTGA AGCCCTCGGACACCGCCATGTATTACTGTGCGAGGTG TAGTCTCAGCTGCGACTACTACGGAGTGAACCTCTGG GGCCAAGGGACCACGGTCACCGTCTCCTCA |
| 278 | 4434 | 738 | QVQLVQSGAEVKKPGESLKISCQGSGYSFSSFWIVWVRQ MPGKGLEWMGSIYPGDSDTRYTPSFQGQVTISADKSTST AYLQWNSLKPSDTAMYYCARCSLSCDYYGVNLWGQGT TVTVSS |
| 278 | 4435 | 739 | YSFSSFWIV |
| 278 | 4436 | 740 | TACAGCTTTAGCAGTTTCTGGATCGTC |
| 278 | 4437 | 741 | SIYPGDSDTRYTPSFQG |
| 278 | 4438 | 742 | AGCATCTATCCTGGTGACTCTGACACCAGATACACCC CGTCCTTCCAAGGC |
| 278 | 4439 | 743 | ARCSLSCDYYGVNL |
| 278 | 4440 | 744 | GCGAGGTGTAGTCTCAGCTGCGACTACTACGGAGTGA ACCTC |
| 278 | 4441 | 745 | CAGTCTGTGGTGACGCAGCCGCCCTCAGTGTCTGGGG CCCCAGGACAGAGGGTCACCATCTCCTGCTCTGGGAG CAGCTCCAACATCGGGGCACGTTCTGATGTACACTGG TACCAGCAGCTTCCAGGAAAAGCCCCCAAACTCCTCA TCTATGGTAACACCAATCGGCCCTTAGGGGTCCCTGA CCGATTCTCTGGCTCCACGTCTGGCACCTCAGCCTCCC TGGCCATCTCTGGGCTCCAGGCTGAGGATGAGGGATA TTATTACTGTCAGTCCTATGACAGCAGCCTGAGTGGTT TTTATGTCTTCGGAACTGGGACCAAGCTCACCGTCCTA |
| 278 | 4442 | 746 | QSVVTQPPSVSGAPGQRVTISCSGSSSNIGARSDVHWYQ QLPGKAPKLLIYGNTNRPLGVPDRFSGSTSGTSASLAISG LQAEDEGYYYCQSYDSSLSGFYVFGTGTKLTVL |
| 278 | 4443 | 747 | SGSSSNIGARSDVH |
| 278 | 4444 | 748 | TCTGGGAGCAGCTCCAACATCGGGGCACGTTCTGATG TACAC |
| 278 | 4445 | 749 | GNTNRPL |
| 278 | 4446 | 750 | GGTAACACCAATCGGCCCTTA |
| 278 | 4447 | 751 | QSYDSSLSGFYV |
| 278 | 4448 | 752 | CAGTCCTATGACAGCAGCCTGAGTGGTTTTTATGTC |
| 279 | 4449 | 753 | CAGGTGCAGCTGGTGGAATCTGGGGGAGGCGTGGTCC AGCCTGGGAGGTCCCTGAGACTCTCCTGTGCAGCCTC TGGATTCCCCTTCAGTCTCTATGCCATGCACTGGGTCC GCCAGGCTCCAGGCAAGGGGCTGGAGTGGGTGGCATT TATATCATATGATGGAAGTAATAAATACTATGCAGAC TCCGTGAAGGGCCGATTCACCATCTCCAGAGACAGTT CCAAGAACACGCTGTATCTGCAAATGGACAGCCTGAC ACCTGAAGACACGGCTGTGTATTACTGTGCGAAACCT ATAGTGGGGCCTACAACGGGTTACTTTGACTACTGGG GCCCGGGAACCCTGGTCACCGTCTCCTCA |
| 279 | 4450 | 754 | QVQLVESGGGVVQPGRSLRLSCAASGFPFSLYAMHWVR QAPGKGLEWVAFISYDGSNKYYADSVKGRFTISRDSSKN TLYLQMDSLTPEDTAVYYCAKPIVGPTTGYFDYWGPGT LVTVSS |
| 279 | 4451 | 755 | FPFSLYAMH |

TABLE 6-continued

Informal Sequence Listing

| Antibody No. | Seq. Ref. No. | SEQ ID NO. | Sequence |
|---|---|---|---|
| 279 | 4452 | 756 | TTCCCCTTCAGTCTCTATGCCATGCAC |
| 279 | 4453 | 757 | FISYDGSNKYYADSVKG |
| 279 | 4454 | 758 | TTTATATCATATGATGGAAGTAATAAATACTATGCAGACTCCGTGAAGGGC |
| 279 | 4455 | 759 | AKPIVGPTTGYFDY |
| 279 | 4456 | 760 | GCGAAACCTATAGTGGGGCCTACAACGGGTTACTTTGACTAC |
| 279 | 4457 | 761 | GAAATTGTGTTGACTCAGTCTCCAGCCACCCTGTCTTTGTCTCCAGGGGAAAGAGCCACCCTCTCCTGCAGGGCCAGTCAGAGTGTTAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGTGGCAGTGGGTCTGGGACAGACTTCACTCTCACCATCAGCAGCCTAGAGCCTGAAGATTTTGCAGTTTATTACTGTCAGCAGCGTAGCAACTGGTACACTTTTGGCCAGGGGACCAAGGTGGAAATCAAA |
| 279 | 4458 | 762 | EIVLTQSPATLSLSPGERATLSCRASQSVSSYLAWYQQKPGQAPRLLIYDASNRATGIPARFSGSGSGTDFTLTISSLEPEDFAVYYCQQRSNWYTFGQGTKVEIK |
| 279 | 4459 | 763 | RASQSVSSYLA |
| 279 | 4460 | 764 | AGGGCCAGTCAGAGTGTTAGCAGCTACTTAGCC |
| 279 | 4461 | 765 | DASNRAT |
| 279 | 4462 | 766 | GATGCATCCAACAGGGCCACT |
| 279 | 4463 | 767 | QQRSNWYT |
| 279 | 4464 | 768 | CAGCAGCGTAGCAACTGGTACACT |
| 280 | 4465 | 769 | GAGGTGCAGCTGGTGGAGTCTGGGGCTGAGGTGAAGAAGCCTGGGGCCTCAGTGAAGGTCTCCTGCCAGACTTCTGGTTACACCTTTAGTCATTTCGGTGTCACCTGGATACGACAGGCCCCAGGACAAGGGCTTGAGTGGCTGGGATGGATCAGCGCTTACAATGGTAACACAGACTATGCAGACAAACTGCAGGGCAGACTCACCATGACCACAGACACATCCACGAACACCGCCTACATGGAATTGAGGAGCCTCAGATCTGACGACACGGCCGTCTATTACTGTGCGAGAGATCCCCCCGCATCAGCTGCTGCGATGCTTGACTACTGGGGCCAGGGAACCCTGGTCACCGTCTCCTCA |
| 280 | 4466 | 770 | EVQLVESGAEVKKPGASVKVSCQTSGYTFSHFGVTWIRQAPGQGLEWLGWISAYNGNTDYADKLQGRLTMTTDTSTNTAYMELRSLRSDDTAVYYCARDPPASAAAMLDYWGQGTLVTVSS |
| 280 | 4467 | 771 | YTFSHFGVT |
| 280 | 4468 | 772 | TACACCTTTAGTCATTTCGGTGTCACC |
| 280 | 4469 | 773 | WISAYNGNTDYADKLQG |
| 280 | 4470 | 774 | TGGATCAGCGCTTACAATGGTAACACAGACTATGCAGACAAACTGCAGGGC |
| 280 | 4471 | 775 | ARDPPASAAAMLDY |
| 280 | 4472 | 776 | GCGAGAGATCCCCCCGCATCAGCTGCTGCGATGCTTGACTAC |
| 280 | 4473 | 777 | GATATTGTGATGACTCAGTCTCCACTCTCCCTGCCCGTCACCCTTGGACAGCCGGCCTCCATCTCCTGCAAGTCTAGTCAAGGCCTCGAATACACTGATGGAAACACCTACTTGAGTTGGTTTCAGCAGAGGCCAGGCCAATCTCCAAGGCGCCTCATTTATAAGATTTCTAACCGGGACTCTGGGGTTCCAGACAGATTCAGCGGCAGTGGGTCAGGCACTGATTTCACACTGAGAATCAGCAGGGTGGAGGCTGAGGATG |

TABLE 6-continued

Informal Sequence Listing

| Antibody No. | Seq. Ref. No. | SEQ ID NO. | Sequence |
|---|---|---|---|
| | | | TTGGGGTTTATTACTGCATGCAAGGTACACACGGGCG<br>GGGAATCTCTTTCGGTCCTGGGACCAAAGTGGATATC<br>AAA |
| 280 | 4474 | 778 | DIVMTQSPLSLAVTLGQPASISCKSSQGLEYTDGNTYLS<br>WFQQRPGQSPRRLIYKISNRDSGVPDRFSGSGSGTDFTLR<br>ISRVEAEDVGVYYCMQGTHGRGISFGPGTKVDIK |
| 280 | 4475 | 779 | KSSQGLEYTDGNTYLS |
| 280 | 4476 | 780 | AAGTCTAGTCAAGGCCTCGAATACACTGATGGAAACA<br>CCTACTTGAGT |
| 280 | 4477 | 781 | KISNRDS |
| 280 | 4478 | 782 | AAGATTTCTAACCGGGACTCT |
| 280 | 4479 | 783 | MQGTHGRGIS |
| 280 | 4480 | 784 | ATGCAAGGTACACACGGGCGGGGAATCTCT |
| 281 | 4481 | 785 | CAGGTGCAGCTGGTGCAGTCTGGGGCTGAAGTGAAGA<br>AGCCTGGGGCCTCAGTGAAGGTCTCCTGCAAGGCTTC<br>TGGATACACCTTCACCGACTACTTTATACACTGGGTGC<br>GCCAGGCCCCTGGAGAAGGGCTTGAGTGGATGGGTTG<br>GGTCAACCCTCTCAGTGACAACACAAAATATTCACAG<br>AAGTTTCAGGGCAGGGTCACCATGAGCACGGACACGT<br>CCATCACCACGGCCTACATGTACCTGAGCAGGCTGCG<br>ATTTGACGACACGGCCGTGTATTTTTGTGCGAGCCAAT<br>CTTCCCCCTATACCCCGGGCGCTCTGGACGTCTGGGGC<br>CAAGGGACCACGGTCACCGTCTCCTCA |
| 281 | 4482 | 786 | QVQLVQSGAEVKKPGASVKVSCKASGYTFTDYFIHWVR<br>QAPGEGLEWMGWVNPLSDNTKYSQKFQGRVTMSTDTS<br>ITTAYMYLSRLRFDDTAVYFCASQSSPYTPGALDVWGQ<br>GTTVTVSS |
| 281 | 4483 | 787 | YTFTDYFIH |
| 281 | 4484 | 788 | TACACCTTCACCGACTACTTTATACAC |
| 281 | 4485 | 789 | WVNPLSDNTKYSQKFQG |
| 281 | 4486 | 790 | TGGGTCAACCCTCTCAGTGACAACACAAAATATTCAC<br>AGAAGTTTCAGGGC |
| 281 | 4487 | 791 | ASQSSPYTPGALDV |
| 281 | 4488 | 792 | GCGAGCCAATCTTCCCCCTATACCCCGGGCGCTCTGG<br>ACGTC |
| 281 | 4489 | 793 | GACATCCAGTTGACCCAGTCTCCATCCTCCCTGCCTGC<br>ATCTGTAGGAGACAGAGTCACCATCACTTGCCGGGCA<br>AGTCAGAACATTGGGAACAATTTAGCTTGGTATCAGC<br>AGAAAGCAGGAAGAGCCCCCAAACTCCTGATCTATAG<br>TGCGTCTAATTTCCATAGTGGGGTCCCATCAAGATTCA<br>TTGGCAGTGGATCTGGGACAGTTTTCACTCTCACCATC<br>AGCAGTCTGCAACCTGAAGATTTTGCAACCTACTTCTG<br>TCAACAGAGTTTCACTCCCCAATTCACTTTCGGCCCTG<br>GGACCAAGGTGGAAATCAAA |
| 281 | 4490 | 794 | DIQLTQSPSSLPASVGDRVTITCRASQNIGNNLAWYQQK<br>AGRAPKLLIYSASNFHSGVPSRFIGSGSGTVFTLTISSLQP<br>EDFATYFCQQSFTPQFTFGPGTKVEIK |
| 281 | 4491 | 795 | RASQNIGNNLA |
| 281 | 4492 | 796 | CGGGCAAGTCAGAACATTGGGAACAATTTAGCT |
| 281 | 4493 | 797 | SASNFHS |
| 281 | 4494 | 798 | AGTGCGTCTAATTTCCATAGT |
| 281 | 4495 | 799 | QQSFTPQFT |

TABLE 6-continued

Informal Sequence Listing

| Antibody No. | Seq. Ref. No. | SEQ ID NO. | Sequence |
|---|---|---|---|
| 281 | 4496 | 800 | CAACAGAGTTTCACTCCCCAATTCACT |
| 282 | 4497 | 801 | CAGGTCCAGCTGGTGCAGTCTGGGGCTGAGGTGAAGA<br>GGCCTGGGTCCTCGGTGAGGGTCTCCTGCAAGGCTTC<br>TGGAGGCACCTTCAGGAAGTATGCTATCAGTTGGGTG<br>CGACAGGCCCGTGGACAAGGGCTTGAGTGGATGGGA<br>GGCATCATCCCTATGTCCGGACCACCAAGCTACGCAC<br>AGAAGTTTCAGGGCAGAGTCACGATTACCGCGGACGA<br>ATCCACGAGCACAGTCTACATGGAGCTGAGCAGCCTG<br>AGATTTGAGGACACGGCCGTGTATTTCTGTGCGAGGG<br>ATATCGAGTGGTTCGTACTCATGGACCCTATCACATCC<br>TACTACCCTATGGACGTCTGGGGCCAAGGGACCACGG<br>TCACCGTCTCCTCA |
| 282 | 4498 | 802 | QVQLVQSGAEVKRPGSSVRVSCKASGGTFRKYAISWVR<br>QARGQGLEWMGGIIPMSGPPSYAQKFQGRVTITADESTS<br>TVYMELSSLRFEDTAVYFCARDIEWFVLMDPITSYYPMD<br>VWGQGTTVTVSS |
| 282 | 4499 | 803 | GTFRKYAIS |
| 282 | 4500 | 804 | GGCACCTTCAGGAAGTATGCTATCAGT |
| 282 | 4501 | 805 | GIIPMSGPPSYAQKFQG |
| 282 | 4502 | 806 | GGCATCATCCCTATGTCCGGACCACCAAGCTACGCAC<br>AGAAGTTTCAGGGC |
| 282 | 4503 | 807 | ARDIEWFVLMDPITSYYPMDV |
| 282 | 4504 | 808 | GCGAGGGATATCGAGTGGTTCGTACTCATGGACCCTA<br>TCACATCCTACTACCCTATGGACGTC |
| 282 | 4505 | 809 | CAGTCTGTGGTGACCCAGGAGCCCTCACTGACTGTGT<br>CCCCAGGAGGGACAGTCACTCTCACCTGTGGCTCCAG<br>CACTGGAGGTGTCACCAGTGGTCATCATACATACTGG<br>TTCCAGCAGAAGCCTGGCCAAGCCCCCAGGACACTGA<br>TCTATGATACGACCAACACACACTCCTGGACACCAGC<br>CCGGTTCGCAGGCTCCCTCCTTGGGGGCAAAGCTGCC<br>CTGACCCTTTCGGGTGCGCAGCCTGAGGATGAGGCTG<br>ACTATTACTGCCTCCTCTCCTATAGTGGTGCGCGGCCG<br>GTGTTCGGCGGAGGGACCAAGCTGACCGTCCTA |
| 282 | 4506 | 810 | QSVVTQEPSLTVSPGGTVTLTCGSSTGGVTSGHHTYWFQ<br>QKPGQAPRTLIYDTTNTHSWTPARFAGSLLGGKAALTLS<br>GAQPEDEADYYCLLSYSGARPVFGGGTKLTVL |
| 282 | 4507 | 811 | GSSTGGVTSGHHTY |
| 282 | 4508 | 812 | GGCTCCAGCACTGGAGGTGTCACCAGTGGTCATCATA<br>CATAC |
| 282 | 4509 | 813 | DTTNTHS |
| 282 | 4510 | 814 | GATACGACCAACACACACTCC |
| 282 | 4511 | 815 | LLSYSGARPV |
| 282 | 4512 | 816 | CTCCTCTCCTATAGTGGTGCGCGGCCGGTG |
| 283 | 4513 | 817 | CAGGTGCAGCTGGTGCAGTCTGGGGGAGGCTTGGTCA<br>AGCCTGGAGGGTCCCTGAGACTCTCCTGTGCAGCCTC<br>TGGATTCACCTTCAATGATTACTACATGAATTGGATCC<br>GCCAGGCTCCAGGGAAGGGGCTGGAATGGGTTTCATA<br>CATTAGTAGTAGTGGTGAGACCAAATACTACGCAGAC<br>TCTGTGAAGGGCCGATTCACCATCTCCAGGGACAACG<br>CCAAGAACTCACTGTATCTGGAAATGAACAGCCTGAG<br>AGTCGAGGACACGGCCGTCTACTACTGTGCGAGAGAC<br>GCGGTCATTGTAGTAGGACCGGTTGCTGTTCACTACC<br>AATACTACGCGGACGTCTGGGGCAAAGGGACCACGGT<br>CACCGTCTCTTCA |

TABLE 6-continued

Informal Sequence Listing

| Antibody No. | Seq. Ref. No. | SEQ ID NO. | Sequence |
|---|---|---|---|
| 283 | 4514 | 818 | QVQLVQSGGGLVKPGGSLRLSCAASGFTFNDYYMNWIRQAPGKGLEWVSYISSSGETKYYADSVKGRFTISRDNAKNSLYLEMNSLRVEDTAVYYCARDAVIVVGPVAVHYQYYADVWGKGTTVTVSS |
| 283 | 4515 | 819 | FTFNDYYMN |
| 283 | 4516 | 820 | TTCACCTTCAATGATTACTACATGAAT |
| 283 | 4517 | 821 | YISSSGETKYYADSVKG |
| 283 | 4518 | 822 | TACATTAGTAGTAGTGGTGAGACCAAATACTACGCAGACTCTGTGAAGGGC |
| 283 | 4519 | 823 | ARDAVIVVGPVAVHYQYYADV |
| 283 | 4520 | 824 | GCGAGAGACGCGGTCATTGTAGTAGGACCGGTTGCTGTTCACTACCAATACTACGCGGACGTC |
| 283 | 4521 | 825 | CAGCCAGTGCTGACTCAGCCACCCTCAGCGTCTGGGACCCCCGGGCAGAGGGTCACCATCTCTTGTTCTGGAAGCACCTCCAACATCGGAAGTAACACTGTACACTGGTACCAGCAACTCCCAGGAACGGCCCCCAGACTCCTCATCTATGTTATTAATCAGCGGCCCTCAGGGGTCCCAGACCGATTCTCCGGCTCCAAGTCTGGCACCTCAGCCTCCCTGGCCATCAGTGGGCTCCAGTCTGAGGATGAGGCTGATTATTACTGTGCAGCATGGGATGACAGCCTGAATGGTCCGGTGTTCGGCGGAGGGACCAAGCTCACCGTCCTA |
| 283 | 4522 | 826 | QPVLTQPPSASGTPGQRVTISCSGSTSNIGSNTVHWYQQLPGTAPRLLIYVINQRPSGVPDRFSGSKSGTSASLAISGLQSEDEADYYCAAWDDSLNGPVFGGGTKLTVL |
| 283 | 4523 | 827 | SGSTSNIGSNTVH |
| 283 | 4524 | 828 | TCTGGAAGCACCTCCAACATCGGAAGTAACACTGTACAC |
| 283 | 4525 | 829 | VINQRPS |
| 283 | 4526 | 830 | GTTATTAATCAGCGGCCCTCA |
| 283 | 4527 | 831 | AAWDDSLNGPV |
| 283 | 4528 | 832 | GCAGCATGGGATGACAGCCTGAATGGTCCGGTG |
| 284 | 4529 | 833 | CAGGTCCAGCTTGTGCAGTCTGGGGCTGAGGTGAAGAAGCCTGGGTCCTCGGTGAAGGTCTCCTGCAAGGCCTCTGGAGGCACCTTCAGCGGCTACCATATCAGCTGGGTGCGACAGGCCCCTGGACAAGGGCTCGAGTGGATGGGAGGGATCATCCATCTATTTGGGACAGTTAACTACGCTCCGAAGTTCCAGGGCAGAGTCACGATCACCGCGGACGCATCCACGGGCACAGCCTACATGGAGTTAAACAGCCTGATGTCTGAAGACACGGCCGTTTATTATTGTGCGAGAGATGCCTACGAAGTGTGGACTGGTTCTTATCTCCCCCCTTTTGACTACTGGGGCCAGGGAACCCTGGTCACCGTCTCCTCA |
| 284 | 4530 | 834 | QVQLVQSGAEVKKPGSSVKVSCKASGGTFSGYHISWVRQAPGQGLEWMGGIIHLFGTVNYAPKFQGRVTITADASTGTAYMELNSLMSEDTAVYYCARDAYEVWTGSYLPPFDYWGQGTLVTVSS |
| 284 | 4531 | 835 | GTFSGYHIS |
| 284 | 4532 | 836 | GGCACCTTCAGCGGCTACCATATCAGC |
| 284 | 4533 | 837 | GIIHLFGTVNYAPKFQG |
| 284 | 4534 | 838 | GGGATCATCCATCTATTTGGGACAGTTAACTACGCTCCGAAGTTCCAGGGC |
| 284 | 4535 | 839 | ARDAYEVWTGSYLPPFDY |

TABLE 6-continued

Informal Sequence Listing

| Antibody No. | Seq. Ref. No. | SEQ ID NO. | Sequence |
|---|---|---|---|
| 284 | 4536 | 840 | GCGAGAGATGCCTACGAAGTGTGGACTGGTTCTTATC<br>TCCCCCCTTTTGACTAC |
| 284 | 4537 | 841 | GAAATTGTGTTGACACAGTCTCCAGGCACCCTGTCTTT<br>GTCTCCCGGGGAAAGAGTCACCCTCTCCTGCAGGGCC<br>AGTCAGACTGTTACAAGCAGCTACTTAGCCTGGTACC<br>AGCAGAAACCTGGCCAGGCTCCCAGGCTCCTCATCTA<br>TGGTGCATTCACCAGGGCCACTGACATCCCAGACAGG<br>TTCAGTGGCAGTGGGTCTGGGACAGACTTCACTCTCA<br>CCATCAGCAGACTGGAGCCTGAAGATTCTGCAGTATA<br>TTATTGTCAGCAGTATGGTAGCTCATTCCTCACTTTCG<br>GCGGAGGGACCAAAGTGGATATCAAA |
| 284 | 4538 | 842 | EIVLTQSPGTLSLSPGERVTLSCRASQTVTSSYLAWYQQ<br>KPGQAPRLLIYGAFTRATDIPDRFSGSGSGTDFTLTISRLE<br>PEDSAVYYCQQYGSSFLTFGGGTKVDIK |
| 284 | 4539 | 843 | RASQTVTSSYLA |
| 284 | 4540 | 844 | AGGGCCAGTCAGACTGTTACAAGCAGCTACTTAGCC |
| 284 | 4541 | 845 | GAFTRAT |
| 284 | 4542 | 846 | GGTGCATTCACCAGGGCCACT |
| 284 | 4543 | 847 | QQYGSSFLT |
| 284 | 4544 | 848 | CAGCAGTATGGTAGCTCATTCCTCACT |
| 285 | 4545 | 849 | GAGGTGCAGCTGGTGGAGTCTGGGGGAGGCTTGCAAA<br>AGCCCGGGCGGTCCCTGCGACTCTCATGTTCAGCTTCT<br>GGATTCACCTTTGGTGATTATGCTATGAGCTGGTTCCG<br>CCAGGCTCCAGGGAAGGGCCTGGAGTGGGTTGGTTTC<br>ATTAGAAGTAAAGCTTATGTTGGGACCGCAGAATACG<br>CCGCGTCTGTGAAAGGCAGATTCACCATCTCAAGAGA<br>TGATTCCAAAAGCATCGCCTATCTGCACATGAACAGC<br>CTGAAGACCGAGGACACAGCCGTGTATTACTGTACTA<br>GAGATGATATTTTGACTGGTTTTTATGACCGCTCTTAC<br>TATTACGGTATACACGTCTGGGGCCAAGGGACCACGG<br>TCACCGTCTCCTCA |
| 285 | 4546 | 850 | EVQLVESGGGLQKPGRSLRLSCSASGFTFGDYAMSWFR<br>QAPGKGLEWVGFIRSKAYVGTAEYAASVKGRFTISRDD<br>SKSIAYLHMNSLKTEDTAVYYCTRDDILTGFYDRSYYYG<br>IHVWGQGTTVTVSS |
| 285 | 4547 | 851 | FTFGDYAMS |
| 285 | 4548 | 852 | TTCACCTTTGGTGATTATGCTATGAGC |
| 285 | 4549 | 853 | FIRSKAYVGTAEYAASVKG |
| 285 | 4550 | 854 | TTCATTAGAAGTAAAGCTTATGTTGGGACCGCAGAAT<br>ACGCCGCGTCTGTGAAAGGC |
| 285 | 4551 | 855 | TRDDILTGFYDRSYYYGIHV |
| 285 | 4552 | 856 | ACTAGAGATGATATTTTGACTGGTTTTTATGACCGCTC<br>TTACTATTACGGTATACACGTC |
| 285 | 4553 | 857 | GAAATTGTAATGACGCAGTCTCCAGTCACCCTGTCTGT<br>GTCTCCAGGGGAAAGAGCCACCCTCTCCTGCAGGGCC<br>AGTCAGAGTGTTAACAGCAACTTAGCCTGGTACCAGA<br>AGAAACCTGGCCAGGCTCCCAGGCTCCTCATCTATAG<br>TGCATCCACCAGGGCCACTGGTGTCCCAGCCAGGTTC<br>AGTGGCAGTGGGTCTGGGACAGAGTTCACTCTCACCG<br>TCAGCAGCCTTCAGTCTGAAGATTTTGCAGTTTATTAC<br>TGTCAGCAGTATGATAACTGGCCTCCGTACACTTTTGG<br>CCAGGGGACCAAGGTGGAAATCAAA |
| 285 | 4554 | 858 | EIVMTQSPVTLSVSPGERATLSCRASQSVNSNLAWYQKK<br>PGQAPRLLIYSASTRATGVPARFSGSGSGTEFTLTVSSLQ<br>SEDFAVYYCQQYDNWPPYTFGQGTKVEIK |
| 285 | 4555 | 859 | RASQSVNSNLA |

TABLE 6-continued

Informal Sequence Listing

| Antibody No. | Seq. Ref. No. | SEQ ID NO. | Sequence |
|---|---|---|---|
| 285 | 4556 | 860 | AGGGCCAGTCAGAGTGTTAACAGCAACTTAGCC |
| 285 | 4557 | 861 | SASTRAT |
| 285 | 4558 | 862 | AGTGCATCCACCAGGGCCACT |
| 285 | 4559 | 863 | QQYDNWPPYT |
| 285 | 4560 | 864 | CAGCAGTATGATAACTGGCCTCCGTACACT |
| 286 | 4561 | 865 | CAGGTGCAGCTGCAGGAGTCGGGCCCAGGACTGGTGA AGGCCTTCACAGACCCTGTCCCTCACCTGCTCCGCCTCT GGTGCAGCCATCAATAGTGGTGATTATTACTGGAGTT GGATCCGCCAGGCCCCTGGGAGGGGCCTAGAGTGGAT TGGGTCCATTTCCAACCGTGGGGTCACCGACTACAAC CCGTCCCTCAAGAGTCGAGTTATCATATCAGCGGACA CGTCCAAGAATCAGTTCTCCCTGAGGCTGACCTCTGTG ACTGCCACAGACACGGCCGTGTATTATTGTGCCAGAG ATTTGGGTACTTTGGCCTTTGATCCCTACTACTATTAC GGTATTGACGTCTGGGGCCAAGGGACCACGGTCACCG TCTCCTCA |
| 286 | 4562 | 866 | QVQLQESGPGLVRPSQTLSLTCSASGAAINSGDYYWSWI RQAPGRGLEWIGSISNRGVTDYNPSLKSRVIISADTSKNQ FSLRLTSVTATDTAVYYCARDLGTLAFDPYYYYGIDVW GQGTTVTVSS |
| 286 | 4563 | 867 | AAINSGDYYWS |
| 286 | 4564 | 868 | GCAGCCATCAATAGTGGTGATTATTACTGGAGT |
| 286 | 4565 | 869 | SISNRGVTDYNPSLKS |
| 286 | 4566 | 870 | TCCATTTCCAACCGTGGGGTCACCGACTACAACCCGT CCCTCAAGAGT |
| 286 | 4567 | 871 | ARDLGTLAFDPYYYYGIDV |
| 286 | 4568 | 872 | GCCAGAGATTTGGGTACTTTGGCCTTTGATCCCTACTA CTATTACGGTATTGACGTC |
| 286 | 4569 | 873 | GACATCCGGATGACCCAGTCTCCAGCCACCCTGTCTTT GTCTCCAGGGGAAAGAGCCACCCTCTCCTGCAGGGCC AGTCAGAGTGTTAGCAGGCATTTAGCCTGGTACCAAC AAAAACCTGGCCAGGCTCCCCGGCTCCTCATCTATGA TGCATCATACAGGGTCACTGGCGTCCCAGACAGGTTC AGTGGCAGTGGGTCTGGGACAGACTTCACTCTCACCA TCAGCAGCCTGGAGTCTGAAGATTTTGCAATTTATTTC TGTCAGCAGCGTAGCACCTGGCCGACGTTCGGCCAAG GGACCAAGGTGGAAATCAAA |
| 286 | 4570 | 874 | DIRMTQSPATLSLSPGERATLSCRASQSVSRHLAWYQQK PGQAPRLLIYDASYRVTGVPDRFSGSGSGTDFTLTISSLES EDFAIYFCQQRSTWPTFGQGTKVEIK |
| 286 | 4571 | 875 | RASQSVSRHLA |
| 286 | 4572 | 876 | AGGGCCAGTCAGAGTGTTAGCAGGCATTTAGCC |
| 286 | 4573 | 877 | DASYRVT |
| 286 | 4574 | 878 | GATGCATCATACAGGGTCACT |
| 286 | 4575 | 879 | QQRSTWPT |
| 286 | 4576 | 880 | CAGCAGCGTAGCACCTGGCCGACG |
| 287 | 4577 | 881 | CAGGTGCAGCTGGTGGAATCTGGGGCTGAGGTGAAGA AGCCTGGGGCCTCAGTGAAGGTTGCCTGCACGGCGTC TGGATACGCCTTCACCAATTACAACATCCACTGGGTG CGACTGGCCCCTGGACAGGGACTTGAGTGGATGGCAA TTATCAACCCCGGTAGTGGTGGCACAGACTACTCAGA GAAGTTCCAGGGCAGGCTCACCTTGACCAGTGACACG TCCACGAGCACGGTGTACATGACGCTGGGCAGCCTGA GATATGAAGACACGGCCTTTTATTACTGTGCGAGAAG |

TABLE 6-continued

Informal Sequence Listing

| Antibody No. | Seq. Ref. No. | SEQ ID NO. | Sequence |
|---|---|---|---|
| | | | GGGTTACCCTGATTCGGGGAGTTACCCCCTTGACTACT GGGGCCAGGGAACCCTGGTCACCGTCTCCTCA |
| 287 | 4578 | 882 | QVQLVESGAEVKKPGASVKVACTASGYAFTNYNIHWV RLAPGQGLEWMAIINPGSGGTDYSEKFQGRLTLTSDTST STVYMTLGSLRYEDTAFYYCARRGYPDSGSYPLDYWGQ GTLVTVSS |
| 287 | 4579 | 883 | YAFTNYNIH |
| 287 | 4580 | 884 | TACGCCTTCACCAATTACAACATCCAC |
| 287 | 4581 | 885 | IINPGSGGTDYSEKFQG |
| 287 | 4582 | 886 | ATTATCAACCCCGGTAGTGGTGGCACAGACTACTCAG AGAAGTTCCAGGGC |
| 287 | 4583 | 887 | ARRGYPDSGSYPLDY |
| 287 | 4584 | 888 | GCGAGAAGGGGTTACCCTGATTCGGGGAGTTACCCCC TTGACTAC |
| 287 | 4585 | 889 | GATATTGTGATGACGCAGTCTCCATCCTCCCTGTCTGC ATCTCTGGGAGACAGAGTCACCATCACTTGCCGGGCA GGTCGGAGCATTGCCACTTACTTAAATTGGTATCAGC AGAAACCAGGGAAAGCCCCTAAGCTCCTGATCTATGG TGCATCCAGTTTGCAAAGTGGCGTCCCATCAAGGTTC AGTGGCAGTGGCTCTGGGACACATTTCACTCTCACCA TCAGCAGTCTGCAACCTGAGGATTTTGCAACTTACTAC TGTCAACAGAGTTACATCCGCCCTATCACTTTCGGCGG AGGGACCAAGGTGGAGATCAAA |
| 287 | 4586 | 890 | DIVMTQSPSSLSASLGDRVTITCRAGRSIATYLNWYQQK PGKAPKLLIYGASSLQSGVPSRFSGSGSGTHFTLTISSLQP EDFATYYCQQSYIRPITFGGGTKVEIK |
| 287 | 4587 | 891 | RAGRSIATYLN |
| 287 | 4588 | 892 | CGGGCAGGTCGGAGCATTGCCACTTACTTAAAT |
| 287 | 4589 | 893 | GASSLQS |
| 287 | 4590 | 894 | GGTGCATCCAGTTTGCAAAGT |
| 287 | 4591 | 895 | QQSYIRPIT |
| 287 | 4592 | 896 | CAACAGAGTTACATCCGCCCTATCACT |
| 288 | 4593 | 897 | CAGGTGCAGCTGCAGGAGTCCGGCCCAGGACTGGTGA AGCCTTCACAGACCCTGTCCCTCACCTGCACTGTCTCT GGTCGTCTCCTCAGCAGTGGTGATTACTACTGGAGTTG GATCCGCCAGTCCCCAGGGAGGGGCCTGGAGTGGATT GGCTACGTCTATCACAGTGGGACCACCTCGTACAACC CGTCCCTCAAGAGTCGAATTACCATGACAGTGGACAC GTCCAAGAACCAGTTCAACCTGAGGTTGACCTCTGTA ACGGCCGCAGACACGGCCGTGTATTACTGTGCCAGAG ATCTCGGATATAGCAGTTCCTCTCCCGCCTTTTATTAC GGTATAGACTTCTGGGGCCCAGGGACCATGGTCACCG TCTCTTCA |
| 288 | 4594 | 898 | QVQLQESGPGLVKPSQTLSLTCTVSGRLLSSGDYYWSWI RQSPGRGLEWIGYVYHSGTTSYNPSLKSRITMTVDTSKN QFNLRLTSVTAADTAVYYCARDLGYSSSSPAFYYGIDFW GPGTMVTVSS |
| 288 | 4595 | 899 | RLLSSGDYYWS |
| 288 | 4596 | 900 | CGTCTCCTCAGCAGTGGTGATTACTACTGGAGT |
| 288 | 4597 | 901 | YVYHSGTTSYNPSLKS |
| 288 | 4598 | 902 | TACGTCTATCACAGTGGGACCACCTCGTACAACCCGT CCCTCAAGAGT |
| 288 | 4599 | 903 | ARDLGYSSSSPAFYYGIDF |

TABLE 6-continued

Informal Sequence Listing

| Antibody No. | Seq. Ref. No. | SEQ ID NO. | Sequence |
|---|---|---|---|
| 288 | 4600 | 904 | GCCAGAGATCTCGGATATAGCAGTTCCTCTCCCGCCTT TTATTACGGTATAGACTTC |
| 288 | 4601 | 905 | GAAATTGTATTGACACAGTCTCCAGCCACCCTGTCTTT GTCTCCAGGGCAAAGAGCGACCCTCTCCTGCAGGGCC AGTCAGAGTGTTGGCAACTACTTAGCCTGGTACCAAC AAAAACCTGGCCAGGCTCCCAGGCTCCTCATCTATGA TGCATCCAACAGGGTCACTGGCATCCCAGCCAGGTTC AGTGGCAGTGGGTCTGGGACAGACTTCACTCTCACCA TCAGCAGGCTAGAGTCTGAAGATTTTGCAGTTTATTAC TGTCAGCAGCGTAGCAACGGGGTCCTCACTTTCGGCG GAGGGACCAAAGTGGATATCAAA |
| 288 | 4602 | 906 | EIVLTQSPATLSLSPGQRATLSCRASQSVGNYLAWYQQK PGQAPRLLIYDASNRVTGIPARFSGSGSGTDFTLTISRLES EDFAVYYCQQRSNGVLTFGGGTKVDIK |
| 288 | 4603 | 907 | RASQSVGNYLA |
| 288 | 4604 | 908 | AGGGCCAGTCAGAGTGTTGGCAACTACTTAGCC |
| 288 | 4605 | 909 | DASNRVT |
| 288 | 4606 | 910 | GATGCATCCAACAGGGTCACT |
| 288 | 4607 | 911 | QQRSNGVLT |
| 288 | 4608 | 912 | CAGCAGCGTAGCAACGGGGTCCTCACT |
| 289 | 4609 | 913 | GAGGTGCAGCTGTTGGAGTCTGGGGCTGAGGTGAAGA AGCCTGGGGCCTCAGTGAGGGTCTCCTGCAAGGCTTC TGGATACACCTTCACCGACTACTTTATGAACTGGGTGC GACAGGCCCCTGGAGGGGGCCTTGAGTGGATGGGGTG GGTCAATCCTCTCAGTGGAGCCACAAAATATGCACAG AAGTTTCAGGGCAGGGTCACCATGACCACGGACACGT CCATCACCACAGGGTACCTGGACTTGAGGAGCCTGAG AGTTGACGACACGGCCATCTATTTTTGTGCGAGCCAG TCTTCCCCTTACACCCCGGGCGCTATGGGCGTCTGGGG CCAAGGGACCACGGTCACCGTCTCTTCA |
| 289 | 4610 | 914 | EVQLLESGAEVKKPGASVRVSCKASGYTFTDYFMNWV RQAPGGGLEWMGWVNPLSGATKYAQKFQGRVTMTTD TSITTGYLDLRSLRVDDTAIYFCASQSSPYTPGAMGVWG QGTTVTVSS |
| 289 | 4611 | 915 | YTFTDYFMN |
| 289 | 4612 | 916 | TACACCTTCACCGACTACTTTATGAAC |
| 289 | 4613 | 917 | WVNPLSGATKYAQKFQG |
| 289 | 4614 | 918 | TGGGTCAATCCTCTCAGTGGAGCCACAAAATATGCAC AGAAGTTTCAGGGC |
| 289 | 4615 | 919 | ASQSSPYTPGAMGV |
| 289 | 4616 | 920 | GCGAGCCAGTCTTCCCCTTACACCCCGGGCGCTATGG GCGTC |
| 289 | 4617 | 921 | GACATCCAGGTGACCCAGTCTCCATCCTCCCTGTCTGC CTCTGTAGGAGACAGAGTCACCATCACTTGCCGGGCA AGTCAGAGCATTAGCGGCTATTTAAGTTGGTATCAGC AGAAACCAGGGAAAGCCCCTAACCTCCTGATCTATGC TACATCCAATTTATACAGTGGGGTCCCATCAAGGTTC AGTGGCCGTGATTCTGGGACAGATTTCACTCTCACCAT CACCAGTCTGCAACCTGAAGATTTTGCAACTTACTTCT GTCAACTGAATTCCGGTGCCCTATTCACTTTCGGCCCT GGGACCAAGGTGGAGATCAAA |
| 289 | 4618 | 922 | DIQVTQSPSSLSASVGDRVTITCRASQSISGYLSWYQQKP GKAPNLLIYATSNLYSGVPSRFSGRDSGTDFTLTITSLQPE DFATYFCQLNSGALFTFGPGTKVEIK |
| 289 | 4619 | 923 | RASQSISGYLS |

TABLE 6-continued

Informal Sequence Listing

| Antibody No. | Seq. Ref. No. | SEQ ID NO. | Sequence |
|---|---|---|---|
| 289 | 4620 | 924 | CGGGCAAGTCAGAGCATTAGCGGCTATTTAAGT |
| 289 | 4621 | 925 | ATSNLYS |
| 289 | 4622 | 926 | GCTACATCCAATTTATACAGT |
| 289 | 4623 | 927 | QLNSGALFT |
| 289 | 4624 | 928 | CAACTGAATTCCGGTGCCCTATTCACT |
| 290 | 4625 | 929 | CAGGTGCAGCTGCAGGAGTCGGGCCCAGGACTGGTGA AGCCTTCACAGACCCTGTCCCTCACCTGCACTGTCTCT GGTCCCTCCATCAGCGCTGGAGATTACAACTGGAATT GGATCCGCCAGGCCCCAGGGAAGGGCCTGGAGTGGG TTGGATACATCGATTACAGGGGCCTCACCCACTACAA CCCGTCCCTCAAGGGTCGACTTTCCATATTAATGGACA GGTCGGCGAACCAGTTCTCCCTGGAGCTGAATTCTGT GACTGCCGCAGACACGGCCGTCTACTACTGTGCCAGG GACGTGGGGGTCTATAGTGGCTACGATGTCTTTCACT ACTACGGCATGGACGTCTGGGGCCAGGGGACCACGGT CACCGTCTCCTCA |
| 290 | 4626 | 930 | QVQLQESGPGLVKPSQTLSLTCTVSGPSISAGDYNWNWI RQAPGKGLEWVGYIDYRGLTHYNPSLKGRLSILMDRSA NQFSLELNSVTAADTAVYYCARDVGVYSGYDVFHYYG MDVWGQGTTVTVSS |
| 290 | 4627 | 931 | PSISAGDYNWN |
| 290 | 4628 | 932 | CCCTCCATCAGCGCTGGAGATTACAACTGGAAT |
| 290 | 4629 | 933 | YIDYRGLTHYNPSLKG |
| 290 | 4630 | 934 | TACATCGATTACAGGGGCCTCACCCACTACAACCCGT CCCTCAAGGGT |
| 290 | 4631 | 935 | ARDVGVYSGYDVFHYYGMDV |
| 290 | 4632 | 936 | GCCAGGGACGTGGGGGTCTATAGTGGCTACGATGTCT TTCACTACTACGGCATGGACGTC |
| 290 | 4633 | 937 | GAAACGACACTCACGCAGTCTCCAGTCACCCTGTCTTT GTCTCCAGGGGAAAGAGCCACCCTCTCCTGCAGGGCC AGTCAGTATGTTAGGAACAACTACTTAGCCTGGTACC AACACAAACCTGGCCAGGCTCCCAGGCTCCTCATCTA TAGTGCTTCCAGCAGGGTCACTGGCACCCCAGACAGG TTCAGTGGCAGTGGGTCTGGGACAGACTTCACTCTCA CCATCAGCAGACTGGAGCCTGAAGACTTTGCAGTGTA TTACTGTCAGCAGTATGGTGGCTCACCTCCGGTCACTT TCGGCCCTGGGACCAAAGTGGATATCAAA |
| 290 | 4634 | 938 | ETTLTQSPVTLSLSPGERATLSCRASQYVRNNYLAWYQH KPGQAPRLLIYSASSRVTGTPDRFSGSGSGTDFTLTISRLE PEDFAVYYCQQYGGSPPVTFGPGTKVDIK |
| 290 | 4635 | 939 | RASQYVRNNYLA |
| 290 | 4636 | 940 | AGGGCCAGTCAGTATGTTAGGAACAACTACTTAGCC |
| 290 | 4637 | 941 | SASSRVT |
| 290 | 4638 | 942 | AGTGCTTCCAGCAGGGTCACT |
| 290 | 4639 | 943 | QQYGGSPPVT |
| 290 | 4640 | 944 | CAGCAGTATGGTGGCTCACCTCCGGTCACT |
| 291 | 4641 | 945 | GAGGTGCAGCTGTTGGAGTCCGGGGGAGGCTTAGTTC AGCCTGGGGGGTCCCTGAGACTATCCTGTGCAGCCTC TGGATTCACCTTCAGTAATTACTGGATGCACTGGGTCC GCCAAGCTCCAGGGAAGGGGCTGGTGTGGGTCTCACG TATTAGCGGTGATGGAAGTGACACAACCTACGCGGAC TCCGTGGAGGGCCGATTCACCATCTCCAGAGACAACG CCAGGAGTACACTGTATCTTCAACTGAATAGTCTCAC AGGCGACGACACGGCTGTGTATTATTGTGCAAGAGAT |

TABLE 6-continued

Informal Sequence Listing

| Antibody No. | Seq. Ref. No. | SEQ ID NO. | Sequence |
|---|---|---|---|
| | | | TTGTGGACCACCTCGCCCTACTTTGACCTCTGGGGCCA GGGAACCCTGGTCACCGTCTCCTCA |
| 291 | 4642 | 946 | EVQLLESGGGLVQPGGSLRLSCAASGFTFSNYWMHWVR QAPGKGLVWVSRISGDGSDTTYADSVEGRFTISRDNARS TLYLQLNSLTGDDTAVYYCARDLWTTSPYFDLWGQGTL VTVSS |
| 291 | 4643 | 947 | FTFSNYWMH |
| 291 | 4644 | 948 | TTCACCTTCAGTAATTACTGGATGCAC |
| 291 | 4645 | 949 | RISGDGSDTTYADSVEG |
| 291 | 4646 | 950 | CGTATTAGCGGTGATGGAAGTGACACAACCTACGCGG ACTCCGTGGAGGGC |
| 291 | 4647 | 951 | ARDLWTTSPYFDL |
| 291 | 4648 | 952 | GCAAGAGATTTGTGGACCACCTCGCCCTACTTTGACCT C |
| 291 | 4649 | 953 | GAAATTGTATTGACACAGTCTCCTGGCACCCTGTCTGC ATCTATTGGAGACAGAGTCACCATCACTTGCCGGGCC AGTCAGAGTCTTAATGGCTGGTTGGCCTGGTATCAGC AGAAACCAGGGAAAGCCCCTAGGCTCCTCATCTATAA GTCGTCTAGTTTAGAAAGCGGGGTCCCATCAAGGTTC AGCGGCAGTGCATCTGGGACAGAATTCACTCTCACCA TCAGCAGCCTGCAGCCTGACGATTTTGCAACTTATTAC TGCCAACAGTATAATAGTTGGGCGTTCGGCCAAGGGA CCAAGGTGGACGTCAAA |
| 291 | 4650 | 954 | EIVLTQSPGTLSASIGDRVTITCRASQSLNGWLAWYQQK PGKAPRLLIYKSSSLESGVPSRFSGSASGTEFTLTISSLQPD DFATYYCQQYNSWAFGQGTKVDVK |
| 291 | 4651 | 955 | RASQSLNGWLA |
| 291 | 4652 | 956 | CGGGCCAGTCAGAGTCTTAATGGCTGGTTGGCC |
| 291 | 4653 | 957 | KSSSLES |
| 291 | 4654 | 958 | AAGTCGTCTAGTTTAGAAAGC |
| 291 | 4655 | 959 | QQYNSWA |
| 291 | 4656 | 960 | CAACAGTATAATAGTTGGGCG |
| 292 | 4657 | 961 | CAGGTGCAGCTACAGCAGTGGGGCGCAGGACTGTTGA AGCCTTCGGAGACCCTGTCCCTCACCTGCGCTGTCTAT GGTGGGTCCTTCAGTGGTTACTCCTGGAGCTGGATCC GCCAGTCCCCAGGGAAGGGGCTGGAGTGGATTGGAG AAATCAATCATAGAGGAAGCACCAACTACAACCCGTC CCTCAAGAGTCGAGTCACCATATCAGTAGACACGTCG AAGAACCAGTTCTCCCTGAAGCTGAGCTCTGTGACCG CCGCGGACACGGCTGTGTACTACTGTGCGGGGACCAA TTATGGAGAGGTTAATACGAGTAACCAATACTTCTTC GGTATGGACGTCTGGGGCCAAGGGACCACGGTCACCG TCTCCTCA |
| 292 | 4658 | 962 | QVQLQQWGAGLLKPSETLSLTCAVYGGSFSGYSWSWIR QSPGKGLEWIGEINHRGSTNYNPSLKSRVTISVDTSKNQF SLKLSSVTAADTAVYYCAGTNYGEVNTSNQYFFGMDV WGQGTTVTVSS |
| 292 | 4659 | 963 | GSFSGYSWS |
| 292 | 4660 | 964 | GGGTCCTTCAGTGGTTACTCCTGGAGC |
| 292 | 4661 | 965 | EINHRGSTNYNPSLKS |
| 292 | 4662 | 966 | GAAATCAATCATAGAGGAAGCACCAACTACAACCCGT CCCTCAAGAGT |
| 292 | 4663 | 967 | AGTNYGEVNTSNQYFFGMDV |

TABLE 6-continued

Informal Sequence Listing

| Antibody No. | Seq. Ref. No. | SEQ ID NO. | Sequence |
|---|---|---|---|
| 292 | 4664 | 968 | GCGGGGACCAATTATGGAGAGGTTAATACGAGTAACC<br>AATACTTCTTCGGTATGGACGTC |
| 292 | 4665 | 969 | GACATCCGGTTGACCCAGTCTCCATCCTCCCTGTCTGC<br>ATCTGTAGGAGACAGAGTCACCATCACTTGCCGGGCA<br>AGTCAGAGCATTACCACCTATTTAAATTGGTATCAGC<br>AGAAACCAGGGAAAGCCCCTAAACTCCTGATCTATGC<br>TGCATCCAATTTGGAAAGTGGGGTCCCATCAAGTTTC<br>AGTGGCAGTGGATTTGGGACAGACTTCACTCTCACCA<br>TCAGCAGTCTGCAACCTGACGATTTTGCAACTTACTAC<br>TGTCAACAGAGTTACAGTGCCCCGCTCACCTTCGGCG<br>GAGGGACCAAAGTGGATATCAAA |
| 292 | 4666 | 970 | DIRLTQSPSSLSASVGDRVTITCRASQSITTYLNWYQQKP<br>GKAPKLLIYAASNLESGVPSSFSGSGFGTDFTLTISSLQPD<br>DFATYYCQQSYSAPLTFGGGTKVDIK |
| 292 | 4667 | 971 | RASQSITTYLN |
| 292 | 4668 | 972 | CGGGCAAGTCAGAGCATTACCACCTATTTAAAT |
| 292 | 4669 | 973 | AASNLES |
| 292 | 4670 | 974 | GCTGCATCCAATTTGGAAAGT |
| 292 | 4671 | 975 | QQSYSAPLT |
| 292 | 4672 | 976 | CAACAGAGTTACAGTGCCCCGCTCACC |
| 293 | 4673 | 977 | CAGGTCCAGCTGGTACAGTCTGGGGCTGGGGTGAAGA<br>AGCCTGGGGCCTCAGTGAGGGTCTCATGCACGGCCTC<br>TGGATACACCTTCACCGACTACTTTATAAACTGGGTGC<br>GACAGGCCCCTGGAGGGGGCCTTGAGTGGATGGGGTG<br>GGTCAATCCTCTCAGTGGAGCCACAAGATACGCCCAG<br>AACTTTGCGGGCAGGGTCACCATGACCACGGACACGT<br>CCATCACCACAGGATATCTGGACTTACGGAACCTGCG<br>ACTTGACGACACGGCCGTCTATTTTTGTGCGAGCCAGT<br>CTTCACCTTACACGCCGGGCGCTATGGACGTCTGGGG<br>CCAAGGGACCACGGTCACCGTCTCCTCA |
| 293 | 4674 | 978 | QVQLVQSGAGVKKPGASVRVSCTASGYTFTDYFINWVR<br>QAPGGGLEWMGWVNPLSGATRYAQNFAGRVTMTTDTS<br>ITTGYLDLRNLRLDDTAVYFCASQSSPYTPGAMDVWGQ<br>GTTVTVSS |
| 293 | 4675 | 979 | YTFTDYFIN |
| 293 | 4676 | 980 | TACACCTTCACCGACTACTTTATAAAC |
| 293 | 4677 | 981 | WVNPLSGATRYAQNFAG |
| 293 | 4678 | 982 | TGGGTCAATCCTCTCAGTGGAGCCACAAGATACGCCC<br>AGAACTTTGCGGGC |
| 293 | 4679 | 983 | ASQSSPYTPGAMDV |
| 293 | 4680 | 984 | GCGAGCCAGTCTTCACCTTACACGCCGGGCGCTATGG<br>ACGTC |
| 293 | 4681 | 985 | GATATTGTGATGACCCAGTCTCCATCCTCCCTGTCTGC<br>ATCTGTAGGAGACAGAGTCTCCATCACTTGCCGGACA<br>AGTCAGACCATTAGTGGCTATATAAGTTGGTATCAGA<br>AGAAACCAGGAAAAGCCCCTAAACTCCTGATCTATGC<br>TGCATCAAATATGTACAGTGGGGTCCCATCAAGGTTC<br>AGTGGCAGTGAATCTGGGACAGATTTCACTCTCACCA<br>TCACCAGTCTGCAACCTGAAGATTTTGCAACTTACTTC<br>TGTCAACTGAATTCCGGTGCCCTATTCACTTTCGGCCC<br>TGGGACCAAAGTGGATATCAAA |
| 293 | 4682 | 986 | DIVMTQSPSSLSASVGDRVSITCRTSQTISGYISWYQKKP<br>GKAPKLLIYAASNMYSGVPSRFSGSESGTDFTLTITSLQP<br>EDFATYFCQLNSGALFTFGPGTKVDIK |
| 293 | 4683 | 987 | RTSQTISGYIS |

TABLE 6-continued

Informal Sequence Listing

| Antibody No. | Seq. Ref. No. | SEQ ID NO. | Sequence |
|---|---|---|---|
| 293 | 4684 | 988 | CGGACAAGTCAGACCATTAGTGGCTATATAAGT |
| 293 | 4685 | 989 | AASNMYS |
| 293 | 4686 | 990 | GCTGCATCAAATATGTACAGT |
| 293 | 4687 | 991 | QLNSGALFT |
| 293 | 4688 | 992 | CAACTGAATTCCGGTGCCCTATTCACT |
| 294 | 4689 | 993 | GAGGTGCAGCTGGTGGAGTCTGCAGCAGAGGTGAAA AAGCCCGGGGAGTCTCTGAAGATCTCCTGTAAGGGTT CTGGATACAGTTTTGCCAGCCACTGGATCGGTTGGGT CCGCCAAATGCCCGGGAAAGGCCTGGAGTTGATGGGA TTCATCTATCCTGGTGACTCTGATACCAGATACAACCC GTCCTTCCAAGGCCAGGTCACCATCTCAGCCGACAAG TCCATCAGCACCGCCTACCTGCAGTGGACCAGGCTGA AGGCCTCGGACACCGCCATGTACTACTGTGGCCAGGC AGTGGCGGGGGGTGAATATTTCCACCACTGGGGCCAG GGCACCCTGGTCACCGTCTCCTCA |
| 294 | 4690 | 994 | EVQLVESAAEVKKPGESLKISCKGSGYSFASHWIGWVR QMPGKGLELMGFIYPGDSDTRYNPSFQGQVTISADKSIST AYLQWTRLKASDTAMYYCGQAVAGGEYFHHWGQGTL VTVSS |
| 294 | 4691 | 995 | YSFASHWIG |
| 294 | 4692 | 996 | TACAGTTTTGCCAGCCACTGGATCGGT |
| 294 | 4693 | 997 | FIYPGDSDTRYNPSFQG |
| 294 | 4694 | 998 | TTCATCTATCCTGGTGACTCTGATACCAGATACAACCC GTCCTTCCAAGGC |
| 294 | 4695 | 999 | GQAVAGGEYFHH |
| 294 | 4696 | 1000 | GGCCAGGCAGTGGCGGGGGGTGAATATTTCCACCAC |
| 294 | 4697 | 1001 | GATATTGTGATGACGCAGTCTCCAGCCACCCTGTCTGT GTCTCCAGGGGAAAGAGCCACCCTCTCCTGCAGGGCC AGTCAGAGTCTTGGCAGCGACTTAGCCTGGTACCAGC AGAAACCTGGCCAGACTCCCAGGCTCCTCATCTATGA TGCATCCACCAGGGCCACTGGTATCCCAGCCAGGTTC AGTGGCAGTGGGTCTGGGACAGAGTTCACTCTCACCA TCAGCAGCCTGCAGTCTGAAGATTTTGCAGTTTATTAC TGTCAGCACTATAATAATTGGCCCCGGGGGTTCGGCC AAGGGACCAAGGTGGAAATCAAA |
| 294 | 4698 | 1002 | DIVMTQSPATLSVSPGERATLSCRASQSLGSDLAWYQQK PGQTPRLLIYDASTRATGIPARFSGSGSGTEFTLTISSLQSE DFAVYYCQHYNNWPRGFGQGTKVEIK |
| 294 | 4699 | 1003 | RASQSLGSDLA |
| 294 | 4700 | 1004 | AGGGCCAGTCAGAGTCTTGGCAGCGACTTAGCC |
| 294 | 4701 | 1005 | DASTRAT |
| 294 | 4702 | 1006 | GATGCATCCACCAGGGCCACT |
| 294 | 4703 | 1007 | QHYNNWPRG |
| 294 | 4704 | 1008 | CAGCACTATAATAATTGGCCCCGGGGG |
| 295 | 4705 | 1009 | CAGGTGCAGCTGCAGGAGTCGGGCCCAGGACGGGTG AAGCCTTCACAGACCCTGTCCCTCACCTGCACTGTCTC TGGTGTCTCCGTCACCATTAATGATTACTACTGGACTT GGCTCCGCCAGTCCCAGGGAAAGGCCTGGAGTGGAT TGGAAACATCTATAACAGTGGGAGCACCTACCAGAAC CCGTCCCTCCAGAGTCGAGTTACCATGTCAGTGGACA CGGCCAAGAACCACTTCTCCCTGAAGCTGACCTCTGT CACTGCCGCAGATACGGCCGTCTATTACTGTGCCAGA |

TABLE 6-continued

Informal Sequence Listing

| Antibody No. | Seq. Ref. No. | SEQ ID NO. | Sequence |
|---|---|---|---|
| | | | GATTTAGGCACTGCCAACAACTACTACTTCGGTATGG ACGTCTGGGGCCTAGGGACCACGGTCACCGTCTCCTC A |
| 295 | 4706 | 1010 | QVQLQESGPGRVKPSQTLSLTCTVSGVSVTINDYYWTW LRQSPGKGLEWIGNIYNSGSTYQNPSLQSRVTMSVDTAK NHFSLKLTSVTAADTAVYYCARDLGTANNYYFGMDVW GLGTTVTVSS |
| 295 | 4707 | 1011 | VSVTINDYYWT |
| 295 | 4708 | 1012 | GTCTCCGTCACCATTAATGATTACTACTGGACT |
| 295 | 4709 | 1013 | NIYNSGSTYQNPSLQS |
| 295 | 4710 | 1014 | AACATCTATAACAGTGGGAGCACCTACCAGAACCCGT CCCTCCAGAGT |
| 295 | 4711 | 1015 | ARDLGTANNYYFGMDV |
| 295 | 4712 | 1016 | GCCAGAGATTTAGGCACTGCCAACAACTACTACTTCG GTATGGACGTC |
| 295 | 4713 | 1017 | GAAATTGTGATGACGCAGTCTCCAGCCACCCTGTCTTT GTCTCCAGGGGAAAGAGCCACTCTCTCCTGCAGGGCC AGTCAGAGTGTTAGCACCTACTTAGCCTGGTACCAAC AGAAACCTGGCCAGGCTCCCAGGCTCCTCATCTATAA TGGATCCAACAGGGTCACTGGCACCCCAGCCAGGTTC AGTGGCAGTGGGTCTGGGACAGACTTCACTCTCACCA TCAGCAGCGTAGAGCCTGAAGATTTTGCAGTTTATTA CTGTCAGCAGCGTAGCAACTGGCCTCCGTACACTTTTG GCCAGGGGACCAAGGTGGAGATCAAA |
| 295 | 4714 | 1018 | EIVMTQSPATLSLSPGERATLSCRASQSVSTYLAWYQQK PGQAPRLLIYNGSNRVTGTPARFSGSGSGTDFTLTISSVEP EDFAVYYCQQRSNWPPYTFGQGTKVEIK |
| 295 | 4715 | 1019 | RASQSVSTYLA |
| 295 | 4716 | 1020 | AGGGCCAGTCAGAGTGTTAGCACCTACTTAGCC |
| 295 | 4717 | 1021 | NGSNRVT |
| 295 | 4718 | 1022 | AATGGATCCAACAGGGTCACT |
| 295 | 4719 | 1023 | QQRSNWPPYT |
| 295 | 4720 | 1024 | CAGCAGCGTAGCAACTGGCCTCCGTACACT |
| 296 | 4721 | 1025 | CAGGTGCAGCTGCAGGAGTCGGGCCCAGGACTGGTGA AGCCTTCGGAGACCCTGTCCCTCACCTGCTCGGTCTCT GGTGCCTCCGTCACCAGTAGGGAATACTACTGGGGCT GGATCCGCCAGGCCCCCGGGAAGGGTCTGCAGTGGAT TGCCAGCATTCATCACAGTCCTTTTCAAAGTGACGGC AACCCGTCCCTGACGAGTCGCGTCTCCAGTTCCGTAGT CACGTCCAAGAACCAGTTGGCCCTGAGGCTGAGCTCT GTGACCGCCGCAGACACGGCTGTATATTACTGTGCGG GCGCGTTTTGGGAGGTTTGGACTGGCCTTTATTCACCG CCGTTTGACTTTTGGGGCCAGGGAATCCTGGTCACCGT CTCCTCA |
| 296 | 4722 | 1026 | QVQLQESGPGLVKPSETLSLTCSVSGASVTSREYYWGWI RQAPGKGLQWIASIHHSPFQSDGNPSLTSRVSSSVVTSKN QLALRLSSVTAADTAVYYCAGAFWEVWTGLYSPPFDF WGQGILVTVSS |
| 296 | 4723 | 1027 | ASVTSREYYWG |
| 296 | 4724 | 1028 | GCCTCCGTCACCAGTAGGGAATACTACTGGGGC |
| 296 | 4725 | 1029 | SIHHSPFQSDGNPSLTS |
| 296 | 4726 | 1030 | AGCATTCATCACAGTCCTTTTCAAAGTGACGGCAACC CGTCCCTGACGAGT |

TABLE 6-continued

Informal Sequence Listing

| Antibody No. | Seq. Ref. No. | SEQ ID NO. | Sequence |
|---|---|---|---|
| 296 | 4727 | 1031 | AGAFWEVWTGLYSPPFDF |
| 296 | 4728 | 1032 | GCGGGCGCGTTTTGGGAGGTTTGGACTGGCCTTTATTC ACCGCCGTTTGACTTT |
| 296 | 4729 | 1033 | GAAATTGTAATGACACAGTCTCCAGGGACCCTGTCTT TGTCTCCAGGGGAAAGAGCCACCCTCTCCTGCTGGGC CAGTCAGACTGTTAGCAGCGGCTACTTAGCCTGGTAC CAGCAGAAACCTGGCCAGGCTCCCAGGCTCCTCATCT ATGGTGCATCTACCAGGGCCACTGACATCCCAGACAG GTTCAGTGGCAGTGGGTCTGGGACAGGCTTCACTCTC ACCATCAGCAGACTGGAGCCTGAAGATCTTGCAGTCT ATTACTGTCAGCAGTATAGCAGTTCACCACTCACTTTC GGCGGCGGGACCAAGGTGGAAATCAAA |
| 296 | 4730 | 1034 | EIVMTQSPGTLSLSPGERATLSCWASQTVSSGYLAWYQQ KPGQAPRLLIYGASTRATDIPDRFSGSGSGTGFTLTISRLE PEDLAVYYCQQYSSSPLTFGGGTKVEIK |
| 296 | 4731 | 1035 | WASQTVSSGYLA |
| 296 | 4732 | 1036 | TGGGCCAGTCAGACTGTTAGCAGCGGCTACTTAGCC |
| 296 | 4733 | 1037 | GASTRAT |
| 296 | 4734 | 1038 | GGTGCATCTACCAGGGCCACT |
| 296 | 4735 | 1039 | QQYSSSPLT |
| 296 | 4736 | 1040 | CAGCAGTATAGCAGTTCACCACTCACT |
| 297 | 4737 | 1041 | CAGGTGCAGCTGGTGCAGTCTGGAGCTGAGGTGAAGA AGCCTGGGGCCTCAGTGAAGGTCTCGTGCAAGACTTC TGGTTACACCTTTTCCAACTACGGTATCAGCTGGCTGC GACAGGCCCCTGGACAAGGGCTTGAGTGGATGGCATG GATCAGCCCTTATAATGGGAACACAAAGTCTGCACAG AGGTTTCAGGGCAGAGTCATCATGACCACAGACACAT CCACGAGGACAGCCCACATGGAGGTGAAGAGCCTGA GAACTGACGACACGGCCACATATTACTGTGCGAGAGA TCCAGCAGTCGATGCAATACCGATGCTTGACTACTGG GGCCAGGGAACCACGGTCACCGTCTCCTCA |
| 297 | 4738 | 1042 | QVQLVQSGAEVKKPGASVKVSCKTSGYTFSNYGISWLR QAPGQGLEWMAWISPYNGNTKSAQRFQGRVIMTTDTST RTAHMEVKSLRTDDTATYYCARDPAVDAIPMLDYWGQ GTTVTVSS |
| 297 | 4739 | 1043 | YTFSNYGIS |
| 297 | 4740 | 1044 | TACACCTTTTCCAACTACGGTATCAGC |
| 297 | 4741 | 1045 | WISPYNGNTKSAQRFQG |
| 297 | 4742 | 1046 | TGGATCAGCCCTTATAATGGGAACACAAAGTCTGCAC AGAGGTTTCAGGGC |
| 297 | 4743 | 1047 | ARDPAVDAIPMLDY |
| 297 | 4744 | 1048 | GCGAGAGATCCAGCAGTCGATGCAATACCGATGCTTG ACTAC |
| 297 | 4745 | 1049 | GACATCCAGGTGACCCAGTCTCCACTCTCCCTGCCCGT CACCCTTGGACAGCCGGCCTCCATCTCCTGCAGGTCTA GTCAAAGCCTCGTGTACACTGATGGAAACACCTACTT GAGCTGGTTTCAGCAGAGGCCAGGCCAATCTCCAAGG CGCCTAATTTATAGGGTTTCTCACCGGGACTCTGGGGT CCCAGACAGATTCACCGGCAGTGGGTCAGGCACTGAT TTCACACTGATAATCCGCAGGGTGGAGGCTGAGGATG TTGGGGTTTATTACTGCATGCAAGGTACACACTGGCCT CTCACTTTCGGCGGAGGGACCAAGGTGGAAATCAAA |
| 297 | 4746 | 1050 | DIQVTQSPLSLPVTLGQPASISCRSSQSLVYTDGNTYLSW FQQRPGQSPRRLIYRVSHRDSGVPDRFTGSGSGTDFTLIIR RVEAEDVGVYYCMQGTHWPLTFGGGTKVEIK |

TABLE 6-continued

Informal Sequence Listing

| Antibody No. | Seq. Ref. No. | SEQ ID NO. | Sequence |
|---|---|---|---|
| 297 | 4747 | 1051 | RSSQSLVYTDGNTYLS |
| 297 | 4748 | 1052 | AGGTCTAGTCAAAGCCTCGTGTACACTGATGGAAACACCTACTTGAGC |
| 297 | 4749 | 1053 | RVSHRDS |
| 297 | 4750 | 1054 | AGGGTTTCTCACCGGGACTCT |
| 297 | 4751 | 1055 | MQGTHWPLT |
| 297 | 4752 | 1056 | ATGCAAGGTACACACTGGCCTCTCACT |
| 298 | 4753 | 1057 | CAGGTCCAGCTGGTGCAGTCTGGGGGAGGCGTGGTCCAGCCTGGGAGGTCCCTGAGACTCTCCTGTGCAGCCTCTGGATTCACGTTCAGTGACTATGCCATGCACTGGGTCCGCCAGGCTCCAGGCAAGGGGCTGGAGTGGGTGGCAATCATATCATATGATGCAAATAATAAATATTATGCAGACTCCGTGAAGGGCCGATTCACCATCTCCAGAGACAATTCCAAGAACACGGTGTATCTGCAAATGAACAGCCTGAGACCTGAGGACACGGCTGTATATTACTGTGCGAAAGAAGAGTGGCTGGTGCCAGCCTACTGGGGCCAGGGAATCCTGGTCACCGTCTCCTCA |
| 298 | 4754 | 1058 | QVQLVQSGGGVVQPGRSLRLSCAASGFTFSDYAMHWVRQAPGKGLEWVAIISYDANNKYYADSVKGRFTISRDNSKNTVYLQMNSLRPEDTAVYYCAKEEWLVPAYWGQGILVTVSS |
| 298 | 4755 | 1059 | FTFSDYAMH |
| 298 | 4756 | 1060 | TTCACGTTCAGTGACTATGCCATGCAC |
| 298 | 4757 | 1061 | IISYDANNKYYADSVKG |
| 298 | 4758 | 1062 | ATCATATCATATGATGCAAATAATAAATATTATGCAGACTCCGTGAAGGGC |
| 298 | 4759 | 1063 | AKEEWLVPAY |
| 298 | 4760 | 1064 | GCGAAAGAAGAGTGGCTGGTGCCAGCCTAC |
| 298 | 4761 | 1065 | CAGTCTGTGCTGACTCAGCCTGCCTCCGTGTCTGGGTCTCCTGGACAGTCGATCACCATCTCCTGCACTGGAACCAGCAGTGACGTTGGTGGATATAATTACGTCTCCTGGTACCAACAACACCCAGGCAAAGCCCCCAAACTCTTAATTTATGAGGTCTCTAATCGGCCCTCAGGGGTTTCTAATCGCTTCTCTGGCTCCAAGTCTGGCAACACGGCCTCCCTGACCATCTCTGGGCTCCAGCCTGAGGACGAGGCTGATTATTACTGCAGCTCATATTCAACCAATAGTGCCCCCTTTGGAACTGGGACCAAGCTCACCGTCCTA |
| 298 | 4762 | 1066 | QSVLTQPASVSGSPGQSITISCTGTSSDVGGYNYVSWYQQHPGKAPKLLIYEVSNRPSGVSNRFSGSKSGNTASLTISGLQPEDEADYYCSSYSTNSAPFGTGTKLTVL |
| 298 | 4763 | 1067 | TGTSSDVGGYNYVS |
| 298 | 4764 | 1068 | ACTGGAACCAGCAGTGACGTTGGTGGATATAATTACGTCTCC |
| 298 | 4765 | 1069 | EVSNRPS |
| 298 | 4766 | 1070 | GAGGTCTCTAATCGGCCCTCA |
| 298 | 4767 | 1071 | SSYSTNSAP |
| 298 | 4768 | 1072 | AGCTCATATTCAACCAATAGTGCCCCC |
| 299 | 4769 | 1073 | CAGGTCCAGCTTGTGCAGTCTGGGGGAGGCGTGGTCCAGTCTGGGAGGTCCCTGAGACTCTCCTGTGCAGCGTCTGGATTCACCTTCAGTGACAATGGCATGCACTGGGTCCGCCAGGCTCCAGGCAAGGGGCTGGAGTGGGTGGCAGGAATCTTTCATGATGGGAGTAATAAACAATATGCAGAATCCGTGAAGGGCCGATTCATCATCTCCAGAGACA |

TABLE 6-continued

Informal Sequence Listing

| Antibody No. | Seq. Ref. No. | SEQ ID NO. | Sequence |
|---|---|---|---|
| | | | TTCCAAGAACACTCTCTATCTGCAAATGAACAGCCTG AGAGCCGAGGACACGGCTCTATATTTCTGTGCGAGAG CCCCTTACGATATTTGGAGCGGATATTGTCTTGACTAC TGGGGCCAGGGAACCCTGGTCACCGTCTCCTCA |
| 299 | 4770 | 1074 | QVQLVQSGGGVVQSGRSLRLSCAASGFTFSDNGMHWV RQAPGKGLEWVAGIFHDGSNKQYAESVKGRFIISRDNSK NTLYLQMNSLRAEDTALYFCARAPYDIWSGYCLDYWG QGTLVTVSS |
| 299 | 4771 | 1075 | FTFSDNGMH |
| 299 | 4772 | 1076 | TTCACCTTCAGTGACAATGGCATGCAC |
| 299 | 4773 | 1077 | GIFHDGSNKQYAESVKG |
| 299 | 4774 | 1078 | GGAATCTTTCATGATGGGAGTAATAAACAATATGCAG AATCCGTGAAGGGC |
| 299 | 4775 | 1079 | ARAPYDIWSGYCLDY |
| 299 | 4776 | 1080 | GCGAGAGCCCCTTACGATATTTGGAGCGGATATTGTC TTGACTAC |
| 299 | 4777 | 1081 | GACATCCGGATGACCCAGTCTCCAGCCACCCTGTCTCT GTCTCCAGGGGAAAGCGCCACCCTCTCCTGCAGGGCC AGTCAGAGTGTTATCAACAACTTAGCCTGGTACCAGC AGAGACCTGGCCAGGCTCCCAGGCTCCTCATCTATGG TGCATCTACCAGGGCCACTGGTATCCCAGCCAGGTTC AGTGGCAGTGGGTCTGAGACAGAGTTCACTCTCACTA TCAGCAGCCTGCAGTCTGAAGATTTCGCGGTTTATCAC TGTCAGCAGTATAGTATCTGGCCTCAGACTTTTGGCCA GGGGACCAAGCTGGAGATCAAA |
| 299 | 4778 | 1082 | DIRMTQSPATLSLSPGESATLSCRASQSVINNLAWYQQR PGQAPRLLIYGASTRATGIPARFSGSGSETEFTLTISSLQSE DFAVYHCQQYSIWPQTFGQGTKLEIK |
| 299 | 4779 | 1083 | RASQSVINNLA |
| 299 | 4780 | 1084 | AGGGCCAGTCAGAGTGTTATCAACAACTTAGCC |
| 299 | 4781 | 1085 | GASTRAT |
| 299 | 4782 | 1086 | GGTGCATCTACCAGGGCCACT |
| 299 | 4783 | 1087 | QQYSIWPQT |
| 299 | 4784 | 1088 | CAGCAGTATAGTATCTGGCCTCAGACT |
| 300 | 4785 | 1089 | GAGGTGCAGCTGTTGGAGTCCGGGGGAGGCGTGGTCC AGTCTGGGAGGTCCCTGAGACTCTCCTGTGTAGCGTCT GGATTCACCTTCAGTGACAGTGGCATGCACTGGGTCC GCCAGGCTCCAGGCAAGGGGCTGGAGTGGGTGGCAG GTTTATTTTATGATGGAAGTAATAAACAATATGCAGA CTCCGTGAAGGGCCGATTCACCATCTCCAGAGACAAT TCCAAGAGCACACTGTATCTGCAGATGAACAGCCTGA GGGCCGAGGACACGGCTGTTTATTACTGTGCGAGAGC CCCTTACGATATTTGGAGTGGTTATTGTCTTGACTACT GGGGCCAGGGAACCCTGGTCACTGTCTCCTCA |
| 300 | 4786 | 1090 | EVQLLESGGGVVQSGRSLRLSCVASGFTFSDSGMHWVR QAPGKGLEWVAGLFYDGSNKQYADSVKGRFTISRDNSK STLYLQMNSLRAEDTAVYYCARAPYDIWSGYCLDYWG QGTLVTVSS |
| 300 | 4787 | 1091 | FTFSDSGMH |
| 300 | 4788 | 1092 | TTCACCTTCAGTGACAGTGGCATGCAC |
| 300 | 4789 | 1093 | GLFYDGSNKQYADSVKG |
| 300 | 4790 | 1094 | GGTTTATTTTATGATGGAAGTAATAAACAATATGCAG ACTCCGTGAAGGGC |

TABLE 6-continued

Informal Sequence Listing

| Antibody No. | Seq. Ref. No. | SEQ ID NO. | Sequence |
|---|---|---|---|
| 300 | 4791 | 1095 | ARAPYDIWSGYCLDY |
| 300 | 4792 | 1096 | GCGAGAGCCCCTTACGATATTTGGAGTGGTTATTGTCT TGACTAC |
| 300 | 4793 | 1097 | GAAATTGTATTGACACAGTCTCCAGCCACCCTGTATAT GTCTCCAGGGGAAAGAGCCACCCTCTCCTGCAGGGCC AGTCAGAGTGTTAACAACAACTTAGCCTGGTACCAGC AGAGACCTGGCCAGGCTCCCAGGCTCCTCATCTATGG TGCATCTACCAGGGCCACTGGTATCCCAGCCAGGTTC AGTGGCAGTGGGTCTGAGACAGAGTTCACTCTCACTA TCAGCAGCCTGCAGTCTGAAGATTTTGCGGTTTATCAC TGTCAGCAGTATAGTATCTGGCCTCAGACTTTTGGCCA GGGGACCAAGCTGGAGATCAAA |
| 300 | 4794 | 1098 | EIVLTQSPATLYMSPGERATLSCRASQSVNNNLAWYQQ RPGQAPRLLIYGASTRATGIPARFSGSGSETEFTLTISSLQ SEDFAVYHCQQYSIWPQTFGQGTKLEIK |
| 300 | 4795 | 1099 | RASQSVNNNLA |
| 300 | 4796 | 1100 | AGGGCCAGTCAGAGTGTTAACAACAACTTAGCC |
| 300 | 4797 | 1101 | GASTRAT |
| 300 | 4798 | 1102 | GGTGCATCTACCAGGGCCACT |
| 300 | 4799 | 1103 | QQYSIWPQT |
| 300 | 4800 | 1104 | CAGCAGTATAGTATCTGGCCTCAGACT |
| 301 | 4801 | 1105 | CAGGTCCAGCTGGTGCAGTCTGGAGCTGAGGTGAAGA AGCCTGGGGCCTCAGTGAAGGTCTCGTGCAAGACTTC TGGTTACACCTTTTCCAACTACGGTATCAGCTGGCTGC GACAGGCCCCTGGACAAGGGCTTGAGTGGATGGCATG GATCAGCCCTTATAATGGGAACACAAAGTCTGCACAG AGGTTTCAGGGCAGAGTCATCATGACCACAGACACAT CCACGAGGACAGCCCACATGGAGGTGAAGAGCCTGA GAACTGACGACACGGCCACATATTACTGTGCGAGAGA TCCAGCAGTCGATGCAATACCGATGCTTGACTACTGG GGCCAGGGAACCATGGTCACCGTCTCCTCA |
| 301 | 4802 | 1106 | QVQLVQSGAEVKKPGASVKVSCKTSGYTFSNYGISWLR QAPGQGLEWMAWISPYNGNTKSAQRFQGRVIMTTDTST RTAHMEVKSLRTDDTATYYCARDPAVDAIPMLDYWGQ GTMVTVSS |
| 301 | 4803 | 1107 | YTFSNYGIS |
| 301 | 4804 | 1108 | TACACCTTTTCCAACTACGGTATCAGC |
| 301 | 4805 | 1109 | WISPYNGNTKSAQRFQG |
| 301 | 4806 | 1110 | TGGATCAGCCCTTATAATGGGAACACAAAGTCTGCAC AGAGGTTTCAGGGC |
| 301 | 4807 | 1111 | ARDPAVDAIPMLDY |
| 301 | 4808 | 1112 | GCGAGAGATCCAGCAGTCGATGCAATACCGATGCTTG ACTAC |
| 301 | 4809 | 1113 | GAAATTGTGTTGACACAGTCTCCACTCTCCCTGCCCGT CACCCTTGGACAGCCGGCCTCCATCTCCTGCAGGTCTA GTCAAAGCCTCGTGTACACTGATGGAAACACCTACTT GAGCTGGTTTCAGCAGAGGCCAGGCCAATCTCCAAGG CGCCTAATTTATAGGGTTTCTCACCGGGACTCTGGGGT CCCAGACAGATTCACCGGCAGTGGGTCAGGCACTGAT TTCACACTGATAATCCGAGGGTGGAGGCTGAGGATG TTGGGGTTTATTACTGCATGCAAGGTACACACTGGCCT CTCACTTTCGGCGGAGGGACCAAGGTGGAAATCAAA |
| 301 | 4810 | 1114 | EIVLTQSPLSLPVTLGQPASISCRSSQSLVYTDGNTYLSW FQQRPGQSPRRLIYRVSHRDSGVPDRFTGSGSGTDFTLIIR RVEAEDVGVYYCMQGTHWPLTFGGGTKVEIK |

TABLE 6-continued

Informal Sequence Listing

| Antibody No. | Seq. Ref. No. | SEQ ID NO. | Sequence |
|---|---|---|---|
| 301 | 4811 | 1115 | RSSQSLVYTDGNTYLS |
| 301 | 4812 | 1116 | AGGTCTAGTCAAAGCCTCGTGTACACTGATGGAAACA CCTACTTGAGC |
| 301 | 4813 | 1117 | RVSHRDS |
| 301 | 4814 | 1118 | AGGGTTTCTCACCGGGACTCT |
| 301 | 4815 | 1119 | MQGTHWPLT |
| 301 | 4816 | 1120 | ATGCAAGGTACACACTGGCCTCTCACT |
| 302 | 4817 | 1121 | GAGGTGCAGCTGGTGGAGTCGGGCCCAAGACTGGTGA GGCCTTCGGAGACCCTGTCCCTCACCTGCACTGTCTCT GGAGGCTTCATCAAAACTAGTAGTTACTACTGGGGCT GGATCCGTCAGCCCCCAGGGAAGGGGCTAGAGTGGAT TGGGAGTATCTATTATGCTGGGACCACCTACTACAAC CCGTCCCTCCAGAGTCGAGTCACCATGTCCGTTGACA CGTCGAACAACCAGTTCTCCCTGAAGCTGAACTCTGT GACCGCCGCAGACACGGCTGTATATTACTGTGCGACC GCCTGGACTTTTGACCACTGGGGCCAGGGAACCCTGG TCACTGTCTCCTCA |
| 302 | 4818 | 1122 | EVQLVESGPRLVRPSETLSLTCTVSGGFIKTSSYYWGWIR QPPGKGLEWIGSIYYAGTTYYNPSLQSRVTMSVDTSNNQ FSLKLNSVTAADTAVYYCATAWTFDHWGQGTLVTVSS |
| 302 | 4819 | 1123 | GFIKTSSYYWG |
| 302 | 4820 | 1124 | GGCTTCATCAAAACTAGTAGTTACTACTGGGGC |
| 302 | 4821 | 1125 | SIYYAGTTYYNPSLQS |
| 302 | 4822 | 1126 | AGTATCTATTATGCTGGGACCACCTACTACAACCCGTC CCTCCAGAGT |
| 302 | 4823 | 1127 | ATAWTFDH |
| 302 | 4824 | 1128 | GCGACCGCCTGGACTTTTGACCAC |
| 302 | 4825 | 1129 | GAAATTGTATTGACACAGTCTCCAGCCACCCTGTCCTT GTCTCCAGGGGAAAGAGCCACCCTCTCCTGCAGGGCC AGTCAGAGTCTTAGCAACTACTTAGCCTGGTACCAAC AGAAACCTGGCCAGGCTCCCAGGCTCCTCATCTATGA TGCATCCAACAGGGCCACTGGCATCCCAGCCAGGTTC AGTGGCAGTGGGTCTGGGACAGACTTCACTCTCACCA TCAGCAGCCTAGAGCCTGAAGATTTTGCAGTTTATTAC TGTCAGCTGCGTGGCCACTGGCCCCCCACGATCACCTT CGGCCAAGGGACACGACTGGAGATTAAA |
| 302 | 4826 | 1130 | EIVLTQSPATLSLSPGERATLSCRASQSLSNYLAWYQQKP GQAPRLLIYDASNRATGIPARFSGSGSGTDFTLTISSLEPE DFAVYYCQLRGHWPPTITFGQGTRLEIK |
| 302 | 4827 | 1131 | RASQSLSNYLA |
| 302 | 4828 | 1132 | AGGGCCAGTCAGAGTCTTAGCAACTACTTAGCC |
| 302 | 4829 | 1133 | DASNRAT |
| 302 | 4830 | 1134 | GATGCATCCAACAGGGCCACT |
| 302 | 4831 | 1135 | QLRGHWPPTIT |
| 302 | 4832 | 1136 | CAGCTGCGTGGCCACTGGCCCCCCACGATCACC |
| 303 | 4833 | 1137 | CAGGTCCAGCTTGTACAGTCTGGGGGAGGCTTGGTTC AGCCGGGGGGGTCCCTGAGACTCTCCTGTGCAGCCTC TGGATTCGCCTTTAGCGACTATACCATGAGCTGGGTCC GCCAGGCTCCAGGGAAGGGGCTGGAGTGGGTCTCAA GTGTTAGTGGCACGGGTGGTACCTCATACTACGCAGA CTCCGTGAATGGCCGGTTCGCCATCTCCAGAGAGAAT TCCAAGAACACGCTGTTTCTGCAAATGGACAGCCTGA GAGCCGAGGACACGGCCACTTACTACTGTGCCAAAGA |

TABLE 6-continued

Informal Sequence Listing

| Antibody No. | Seq. Ref. No. | SEQ ID NO. | Sequence |
|---|---|---|---|
| | | | TGGGTTGAGGGACGTATCGAGGGTTTATTACATCGAC GTCTGGGGCAAAGGGACCACGGTCACCGTCTCCTCA |
| 303 | 4834 | 1138 | QVQLVQSGGGLVQPGGSLRLSCAASGFAFSDYTMSWVR QAPGKGLEWVSSVSGTGGTSYYADSVNGRFAISRENSK NTLFLQMDSLRAEDTATYYCAKDGLRDVSRVYYIDVW GKGTTVTVSS |
| 303 | 4835 | 1139 | FAFSDYTMS |
| 303 | 4836 | 1140 | TTCGCCTTTAGCGACTATACCATGAGC |
| 303 | 4837 | 1141 | SVSGTGGTSYYADSVNG |
| 303 | 4838 | 1142 | AGTGTTAGTGGCACGGGTGGTACCTCATACTACGCAG ACTCCGTGAATGGC |
| 303 | 4839 | 1143 | AKDGLRDVSRVYYIDV |
| 303 | 4840 | 1144 | GCCAAAGATGGGTTGAGGGACGTATCGAGGGTTTATT ACATCGACGTC |
| 303 | 4841 | 1145 | CAGCCTGTGCTGACTCAGCCTGCCTCCGTGTCTGGGTC TCCTGGACAGTCGATCACCATCTCCTGCACTGGAACC AGCCGTGACATTGGTTCTCATGACTCTGTCTCCTGGTA CCAACAAAAGCCAGGCAAAGCCCCCAAACTCATCATT TATGCAGTCAGAAATCGGCCCTCAGGGCTTTCTAATC GCTTCTCTGGTTCCAAGTCTGGCAACACGGCCTCCCTG ACCATCTCTGGGCTCCAGACTGAAGACGAAGGTGACT ATTACTGCAGCTCATATAGAAACGGCAACGCTCTGGG GGTCTTCGGAACTGGGACCAAGGTCACCGTCCTC |
| 303 | 4842 | 1146 | QPVLTQPASVSGSPGQSITISCTGTSRDIGSHDSVSWYQQ KPGKAPKLIIYAVRNRPSGLSNRFSGSKSGNTASLTISGL QTEDEGDYYCSSYRNGNALGVFGTGTKVTVL |
| 303 | 4843 | 1147 | TGTSRDIGSHDSVS |
| 303 | 4844 | 1148 | ACTGGAACCAGCCGTGACATTGGTTCTCATGACTCTGT CTCC |
| 303 | 4845 | 1149 | AVRNRPS |
| 303 | 4846 | 1150 | GCAGTCAGAAATCGGCCCTCA |
| 303 | 4847 | 1151 | SSYRNGNALGV |
| 303 | 4848 | 1152 | AGCTCATATAGAAACGGCAACGCTCTGGGGGTC |
| 304 | 4849 | 1153 | CAGGTGCAGCTGGTGGAGTCTGGGGGAGGCTTGGTTC AGCCGGGGGGGTCCCTGAGACTCTCCTGTGCAGCCTC TGGATTCGCCTTTAGCAACTATGCCATGAGCTGGGTCC GCCAGGCTCCAGGGAAGGGCCTGGAGTGGGTCTCAAG TGTTAGTGGCACGGGTGGTACCACATACTACGCAGAC TCCGTGAACGGGCGGTTCGCCATCTCCAGAGAGAATT CCAGGAACACCCTCTATCTGCAAATGGATAGCCTGAG AGTCGAGGACACGGCCACTTATTACTGTGCCAAAGAT GGGTTGAGGGACTTATCGAGGGTCTATTACATCGACG TCTGGGGCAAAGGGGCCACGGTCACCGTCTCTTCA |
| 304 | 4850 | 1154 | QVQLVESGGGLVQPGGSLRLSCAASGFAFSNYAMSWVR QAPGKGLEWVSSVSGTGGTTYYADSVNGRFAISRENSR NTLYLQMDSLRVEDTATYYCAKDGLRDLSRVYYIDVW GKGATVTVSS |
| 304 | 4851 | 1155 | FAFSNYAMS |
| 304 | 4852 | 1156 | TTCGCCTTTAGCAACTATGCCATGAGC |
| 304 | 4853 | 1157 | SVSGTGGTTYYADSVNG |
| 304 | 4854 | 1158 | AGTGTTAGTGGCACGGGTGGTACCACATACTACGCAG ACTCCGTGAACGGG |
| 304 | 4855 | 1159 | AKDGLRDLSRVYYIDV |

TABLE 6-continued

Informal Sequence Listing

| Antibody No. | Seq. Ref. No. | SEQ ID NO. | Sequence |
|---|---|---|---|
| 304 | 4856 | 1160 | GCCAAAGATGGGTTGAGGGACTTATCGAGGGTCTATT ACATCGACGTC |
| 304 | 4857 | 1161 | CAGTCTGTCCTGACTCAGCCTGCCTCCGTGTCTGGGTC TCCTGGACAGTCGATCACCATCTCCTGCACTGGAACC AGCCGTGACATTGGTAGTCATGACTATGTCTCCTGGTA CCAACAACACCCAGGCAAAGCCCCCAAACTCATCATT TATGGGGTCAATAATCGGCCCTCAGGACTTTCTAATC GCTTCTCTGGTTCCAAGTCTGGCAACACGGCCTCCCTG ACCATCTCTGGGCTCCAGACTGAAGACGAAGGTGACT ATTACTGCAGCTCATATAGAAACGGCAACACTCTGGG GGTCTTCGGAACTGGGACCAAGCTCACCGTCCTA |
| 304 | 4858 | 1162 | QSVLTQPASVSGSPGQSITISCTGTSRDIGSHDYVSWYQQ HPGKAPKLIIYGVNNRPSGLSNRFSGSKSGNTASLTISGL QTEDEGDYYCSSYRNGNTLGVFGTGTKLTVL |
| 304 | 4859 | 1163 | TGTSRDIGSHDYVS |
| 304 | 4860 | 1164 | ACTGGAACCAGCCGTGACATTGGTAGTCATGACTATG TCTCC |
| 304 | 4861 | 1165 | GVNNRPS |
| 304 | 4862 | 1166 | GGGGTCAATAATCGGCCCTCA |
| 304 | 4863 | 1167 | SSYRNGNTLGV |
| 304 | 4864 | 1168 | AGCTCATATAGAAACGGCAACACTCTGGGGGTC |
| 305 | 4865 | 1169 | CAGGTCCAGCTGGTACAGTCTGGGGCTGAGGTGAAGA AGCCTGGGTCCTCGGTGAAGGTCTCCTGCAAGGCCTC TGGAGGCACCTTCAGCGGCTACGCTATCAACTGGGTG CGACAGGCCCCTGGACAAGGGCTCGAGTGGATGGGA GGGATCATCCATATATTTGGGACAGTAAACTACGCTC CGAAGTTCCAGGGCAGACTCACGATAACCGCGGACGC ATCCACGGGCACAGCCTACATGGAATTGAGCAGCCTG ATGTCTGAGGACACGGCCCTATATTATTGTGCGAGAG ATGCTTACGAAGTGTGGACCGGTTCTTATCTCCCCCCT TTTGACTACTGGGGCCAGGGAACCCTGGTCACCGTCT CCTCA |
| 305 | 4866 | 1170 | QVQLVQSGAEVKKPGSSVKVSCKASGGTFSGYAINWVR QAPGQGLEWMGGIIHIFGTVNYAPKFQGRLTITADASTG TAYMELSSLMSEDTALYYCARDAYEVWTGSYLPPFDY WGQGTLVTVSS |
| 305 | 4867 | 1171 | GTFSGYAIN |
| 305 | 4868 | 1172 | GGCACCTTCAGCGGCTACGCTATCAAC |
| 305 | 4869 | 1173 | GIIHIFGTVNYAPKFQG |
| 305 | 4870 | 1174 | GGGATCATCCATATATTTGGGACAGTAAACTACGCTC CGAAGTTCCAGGGC |
| 305 | 4871 | 1175 | ARDAYEVWTGSYLPPFDY |
| 305 | 4872 | 1176 | GCGAGAGATGCTTACGAAGTGTGGACCGGTTCTTATC TCCCCCCTTTTGACTAC |
| 305 | 4873 | 1177 | GAAACGACACTCACGCAGTCTCCAGGCACCCTGTCTT TGTCTCCCGGGGAAAGAGTCACCCTCTCCTGCAGGGC CAGTCAGACTGTTACAAGCAACTACTTAGCCTGGTAC CAGCAGAAACCTGGCCAGGCTCCCAGGCTCCTCATCT ATGATGCATTCACCAGGGCCACTGGCGTCCCAGCCAG GTTCAGTGGCAGTGGGTCTGGGACAGACTTCACTCTC ACCATCAGCAGACTGGAGCCTGAAGATTTTGCAGTTT ACTATTGTCAGCAGTATGGTAGCTCATTCCTCACTTTC GGCGGAGGGACCAAGGTGGAAATCAAA |
| 305 | 4874 | 1178 | ETTLTQSPGTLSLSPGERVTLSCRASQTVTSNYLAWYQQ KPGQAPRLLIYDAFTRATGVPARFSGSGSGTDFTLTISRL EPEDFAVYYCQQYGSSFLTFGGGTKVEIK |

TABLE 6-continued

Informal Sequence Listing

| Antibody No. | Seq. Ref. No. | SEQ ID NO. | Sequence |
|---|---|---|---|
| 305 | 4875 | 1179 | RASQTVTSNYLA |
| 305 | 4876 | 1180 | AGGGCCAGTCAGACTGTTACAAGCAACTACTTAGCC |
| 305 | 4877 | 1181 | DAFTRAT |
| 305 | 4878 | 1182 | GATGCATTCACCAGGGCCACT |
| 305 | 4879 | 1183 | QQYGSSFLT |
| 305 | 4880 | 1184 | CAGCAGTATGGTAGCTCATTCCTCACT |
| 306 | 4881 | 1185 | GAGGTGCAGCTGGTGGAGTCTGGGGGAGGCGTGGTCC AGTCTGGGAGGTCCCTGAGACTCTCCTGTGCAGCATC TGGATTCATCTTCAGTGACAATGGCATGCACTGGGTC CGCCAGGCTCCAGGCAAGGGGCTGGAGTGGGTGGCA GGTATTTTTTATGATGGAAGTAATAAACAATATGCAG ACTCCGTGAAGGGCCGATTCACCATCTCCAGAGACAA TTCCAAGAACACACTGTATCTGCAAATGAAGAGCCTG AGAGCCGAGGACACGGCTGTGTATTACTGTGCGAGAG CCCCTTACGATATCTGGAGTGGTTATTGTCTTGACTAC TGGGGCCAGGGAACCCTGGTCACCGTCTCCTCA |
| 306 | 4882 | 1186 | EVQLVESGGGVVQSGRSLRLSCAASGFIFSDNGMHWVR QAPGKGLEWVAGIFYDGSNKQYADSVKGRFTISRDNSK NTLYLQMKSLRAEDTAVYYCARAPYDIWSGYCLDYWG QGTLVTVSS |
| 306 | 4883 | 1187 | FIFSDNGMH |
| 306 | 4884 | 1188 | TTCATCTTCAGTGACAATGGCATGCAC |
| 306 | 4885 | 1189 | GIFYDGSNKQYADSVKG |
| 306 | 4886 | 1190 | GGTATTTTTTATGATGGAAGTAATAAACAATATGCAG ACTCCGTGAAGGGC |
| 306 | 4887 | 1191 | ARAPYDIWSGYCLDY |
| 306 | 4888 | 1192 | GCGAGAGCCCCTTACGATATCTGGAGTGGTTATTGTCT TGACTAC |
| 306 | 4889 | 1193 | GACATCCAGGTGACCCAGTCTCCAGCCACCCTGTCTA TGTCTCCAGGGGAAAGAGCCACCCTCTCCTGCAGGGC CAGTCAGAGTGTTAACAACAACTTAGCCTGGTACCAG CAGAGACCTGGCCAGGCTCCCAGGCTCCTCATCTATG GTGCATCTACGAGGGCCACTGGTATCCCAGCCAGGTT CAGTGGCAGTGGGTCTGAGACAGAGTTCACTCTCACT ATCAGCAGCCTGCAGTCTGAAGATTTTGCGGTTTATCA CTGTCAGCAGTATAGTATCTGGCCTCAGACTTTTGGCC AGGGGACCAAGGTGGAAATCAAA |
| 306 | 4890 | 1194 | DIQVTQSPATLSMSPGERATLSCRASQSVNNNLAWYQQ RPGQAPRLLIYGASTRATGIPARFSGSGSETEFTLTISSLQ SEDFAVYHCQQYSIWPQTFGQGTKVEIK |
| 306 | 4891 | 1195 | RASQSVNNNLA |
| 306 | 4892 | 1196 | AGGGCCAGTCAGAGTGTTAACAACAACTTAGCC |
| 306 | 4893 | 1197 | GASTRAT |
| 306 | 4894 | 1198 | GGTGCATCTACGAGGGCCACT |
| 306 | 4895 | 1199 | QQYSIWPQT |
| 306 | 4896 | 1200 | CAGCAGTATAGTATCTGGCCTCAGACT |
| 307 | 4897 | 1201 | CAGGTCCAGCTTGTACAGTCTGGGGCTGAACTAAAGA AGCCTGGCTCCTCGGTGAAAGTCTCCTGCAAGGCTTCT GCAGACACCTTCAAAAGTTATGCTATCAACTGGGTGC GGCAGGCCCCTGGACAAGGACTTGAGTGGATGGGAG AGTTCATCCCAATCTTTGGTGTCTCACCCTCCGCACAG AAGTTCCAGGGCAGAGTCACCATTACCGCGGACAGAT CCACGTCCACAGCCTACATGGAGTTGAGCAGCCTGAA |

TABLE 6-continued

Informal Sequence Listing

| Antibody No. | Seq. Ref. No. | SEQ ID NO. | Sequence |
|---|---|---|---|
| | | | ATCTGATGACTCGGCCATTTATTACTGTGCGACACGTC TGTATACGTTGGGGTCCCCTTTTGACAATTGGGGCCAG GGGACCACGGTCACCGTCTCCTCA |
| 307 | 4898 | 1202 | QVQLVQSGAELKKPGSSVKVSCKASADTFKSYAINWVR QAPGQGLEWMGEFIPIFGVSPSAQKFQGRVTITADRSTST AYMELSSLKSDDSAIYYCATRLYTLGSPFDNWGQGTTV TVSS |
| 307 | 4899 | 1203 | DTFKSYAIN |
| 307 | 4900 | 1204 | GACACCTTCAAAAGTTATGCTATCAAC |
| 307 | 4901 | 1205 | EFIPIFGVSPSAQKFQG |
| 307 | 4902 | 1206 | GAGTTCATCCCAATCTTTGGTGTCTCACCCTCCGCACA GAAGTTCCAGGGC |
| 307 | 4903 | 1207 | ATRLYTLGSPFDN |
| 307 | 4904 | 1208 | GCGACACGTCTGTATACGTTGGGGTCCCCTTTTGACAA T |
| 307 | 4905 | 1209 | CAGCCTGTGCTGACTCAGCCTCGCTCAGTGTCCGGGTC TCCTGGACAGTCAGTCACCATCTCCTGCACTGGAACC AGTAGTGATGTTGGTGATTATGACTATGTCTCCTGGTA CCAACACCTCCCAGGCGAAGTCCCCAAACTCATAGTT TATAATGTCATTAAGCGGCCCTCTGGGGTCCCTGATCG CTTCTCTGGCTCCAAGTCTGGCAACACGGCCTCCCTGA CCATCTCTGGGCTCCAGGCTGAGGATGAGGCTGACTA TTACTGCTGCTCATATGCAGGCAGGTATATTTATGTCT TCGGCAGTGGGACCAAGCTCACCGTCCTA |
| 307 | 4906 | 1210 | QPVLTQPRSVSGSPGQSVTISCTGTSSDVGDYDYVSWYQ HLPGEVPKLIVYNVIKRPSGVPDRFSGSKSGNTASLTISG LQAEDEADYYCCSYAGRYIYVFGSGTKLTVL |
| 307 | 4907 | 1211 | TGTSSDVGDYDYVS |
| 307 | 4908 | 1212 | ACTGGAACCAGTAGTGATGTTGGTGATTATGACTATG TCTCC |
| 307 | 4909 | 1213 | NVIKRPS |
| 307 | 4910 | 1214 | AATGTCATTAAGCGGCCCTCT |
| 307 | 4911 | 1215 | CSYAGRYIYV |
| 307 | 4912 | 1216 | TGCTCATATGCAGGCAGGTATATTTATGTC |
| 308 | 4913 | 1217 | GAGGTGCAGCTGTTGGAGTCTGGGGGAGGCCTGGTCA AGCCTGGGGAGTCCCTGAGACTCTCCTGTGCAGCCTC TGGATTCACCCTTAGTGGCTACTACATGAATTGGGTCC GCCAGGCTCCAGGGAGGGGGCTGGAGTGGGTCTCCTC CATTAGTGGTGGTAGTAATTACATAAACTACGCCGAC TCAGTGAAGGGCCGGTTCACCATCTCCAGAGACAACG CCAAGAACTCACTCTATCTGCAAATGAACAGCCTGAG AGTCGAGGACACGGCTGTCTATTACTGTGCGAGGGTC CACGTGGATTAGTGACTACGATTTTTGGGGTTGACTT TGACTTCTGGGGCCAGGGAACCCTGGTCACTGTCTCCT CA |
| 308 | 4914 | 1218 | EVQLLESGGGLVKPGESLRLSCAASGFTLSGYYMNWVR QAPGRGLEWVSSISGGSNYINYADSVKGRFTISRDNAKN SLYLQMNSLRVEDTAVYYCARVHVDLVTTIFGVDFDFW GQGTLVTVSS |
| 308 | 4915 | 1219 | FTLSGYYMN |
| 308 | 4916 | 1220 | TTCACCCTTAGTGGCTACTACATGAAT |
| 308 | 4917 | 1221 | SISGGSNYINYADSVKG |
| 308 | 4918 | 1222 | TCCATTAGTGGTGGTAGTAATTACATAAACTACGCCG ACTCAGTGAAGGGC |

TABLE 6-continued

Informal Sequence Listing

| Antibody No. | Seq. Ref. No. | SEQ ID NO. | Sequence |
|---|---|---|---|
| 308 | 4919 | 1223 | ARVHVDLVTTIFGVDFDF |
| 308 | 4920 | 1224 | GCGAGGGTCCACGTGGATTTAGTGACTACGATTTTTGGGGTTGACTTTGACTTC |
| 308 | 4921 | 1225 | CAGTCTGTGCTGACGCAGCCGCCCTCAGTGTCTGGGGCCCCAGGGCAGAGGGTCACCATCTCCTGCACTGGGAGCAGCTCCAACATCGGGGCAGGGTATGATGTACACTGGTACCAGCAACTTCCAGGAACAGCCCCCAAACTCCTCATCTATGGTAACACCAATCGGCCCGCAGGGGTCCCTGACCCGATTCTCTGGCTCCAAGTCTGGCTCCTCAGCCTCCCTGGCCATCACTGGGCTCCAGGCTGAGGATGAGGCTGATTATTACTGCCAGTCGTATGACAGCAGCCTGAGTGGTGCGATCTTCGGCGGAGGGACCAAGCTCACCGTCCTA |
| 308 | 4922 | 1226 | QSVLTQPPSVSGAPGQRVTISCTGSSSNIGAGYDVHWYQQLPGTAPKLLIYGNTNRPAGVPDRFSGSKSGSSASLAITGLQAEDEADYYCQSYDSSLSGAIFGGGTKLTVL |
| 308 | 4923 | 1227 | TGSSSNIGAGYDVH |
| 308 | 4924 | 1228 | ACTGGGAGCAGCTCCAACATCGGGGCAGGGTATGATGTACAC |
| 308 | 4925 | 1229 | GNTNRPA |
| 308 | 4926 | 1230 | GGTAACACCAATCGGCCCGCA |
| 308 | 4927 | 1231 | QSYDSSLSGAI |
| 308 | 4928 | 1232 | CAGTCGTATGACAGCAGCCTGAGTGGTGCGATC |
| 309 | 4929 | 1233 | CAGGTGCAGCTGCAGGAGTCCGGAGCTGAGGTGAAGATGCGTGGGGCCTCAGTGAAGGTCTCCTGCAAGGCTTCTGGTTACACCTTTAGTCACTATGGTATCAGTTGGGTGCGACAGGCCCCTGGACAAGGGCTCGAGTGGATGGGATTTATCAGCGCTTACAATCATAACACAAAGTATGCACAGACCGTCCAGGGCAGAGTCACCTTGAGCACAGACACATCCACGAGCACAGCCTACATGGAGCTGAGGAGCCTGAGACCTGACGACACGGCCATGTATTACTGTGCGAGAGAACCCCCGAGTGACGATGCTGCAAGGCTCTTTGACTACTGGGGCCAGGGAACCCTGGTCACTGTCTCCTCA |
| 309 | 4930 | 1234 | QVQLQESGAEVKMRGASVKVSCKASGYTFSHYGISWVRQAPGQGLEWMGFISAYNHNTKYAQTVQGRVTLSTDTSTSTAYMELRSLRPDDTAMYYCAREPPSDDAARLFDYWGQGTLVTVSS |
| 309 | 4931 | 1235 | YTFSHYGIS |
| 309 | 4932 | 1236 | TACACCTTTAGTCACTATGGTATCAGT |
| 309 | 4933 | 1237 | FISAYNHNTKYAQTVQG |
| 309 | 4934 | 1238 | TTTATCAGCGCTTACAATCATAACACAAAGTATGCACAGACCGTCCAGGGC |
| 309 | 4935 | 1239 | AREPPSDDAARLFDY |
| 309 | 4936 | 1240 | GCGAGAGAACCCCCGAGTGACGATGCTGCAAGGCTCTTTGACTAC |
| 309 | 4937 | 1241 | GAAACGACACTCACGCAGTCTCCACGCTCCCTGCCCGTCACCCTTGGACAGCCGGCCTCCATCTCCTGCAGGTCTAGTCAAAGCCTCGTGTACAGTGAAGGAAACACCTACTTGAGTTGGTTTCAGCAGAGGCCAGGCCAATCTCCAAGGCGCCTAATTTATAAGGTTTCTAACCGGGACTCTGGGGTCCCAGACAGATTCAGCGGCAGTGGGTCAGGCACTGATTTCACACTGAAAATCAGCAGGGTGGAGGCTGAGGATGTTGGGGTTTATTATTGCATGCAAGGTACACAGTGGCCTGTGACATTCGGCCAAGGGACCAAGGTGGAAATCAAA |

TABLE 6-continued

Informal Sequence Listing

| Antibody No. | Seq. Ref. No. | SEQ ID NO. | Sequence |
|---|---|---|---|
| 309 | 4938 | 1242 | ETTLTQSPRSLPVTLGQPASISCRSSQSLVYSEGNTYLSW FQQRPGQSPRRLIYKVSNRDSGVPDRFSGSGSGTDFTLKI SRVEAEDVGVYYCMQGTQWPVTFGQGTKVEIK |
| 309 | 4939 | 1243 | RSSQSLVYSEGNTYLS |
| 309 | 4940 | 1244 | AGGTCTAGTCAAAGCCTCGTGTACAGTGAAGGAAACA CCTACTTGAGT |
| 309 | 4941 | 1245 | KVSNRDS |
| 309 | 4942 | 1246 | AAGGTTTCTAACCGGGACTCT |
| 309 | 4943 | 1247 | MQGTQWPVT |
| 309 | 4944 | 1248 | ATGCAAGGTACACAGTGGCCTGTGACA |
| 310 | 4945 | 1249 | CAGGTCCAGCTGGTACAGTCTGGGGCTGAGGTGAAGA AGCCTGGGGCCTCAGTGAGGGTCTCCTGCAAGGTTTA CGGTCACACCCTCAGTGAATTATCCATGCACTGGGTG CGACAGGGTCCTGAAGGAGGCCTTGAGTGGATGGGA GCTTTTGATCATGAAGATGGTGAAGGAATCTACCCAC AGAAGTTCCAGGGCAGAATCACCATGACCGCGGACAT ATCGACAGACACAGCCCACATGGAACTGAGGAGCCTC AGATCTGAGGACACGGCCGTTTATTACTGTGCAACAC CGACCCCGGTTGGAGCAACGGACTTCTGGGGCCAGGG AACCCTGGTCACCGTCTCCTCA |
| 310 | 4946 | 1250 | QVQLVQSGAEVKKPGASVRVSCKVYGHTLSELSMHWV RQGPEGGLEWMGAFDHEDGEGIYPQKFQGRITMTADIS TDTAHMELRSLRSEDTAVYYCATPTPVGATDFWGQGTL VTVSS |
| 310 | 4947 | 1251 | HTLSELSMH |
| 310 | 4948 | 1252 | CACACCCTCAGTGAATTATCCATGCAC |
| 310 | 4949 | 1253 | AFDHEDGEGIYPQKFQG |
| 310 | 4950 | 1254 | GCTTTTGATCATGAAGATGGTGAAGGAATCTACCCAC AGAAGTTCCAGGGC |
| 310 | 4951 | 1255 | ATPTPVGATDF |
| 310 | 4952 | 1256 | GCAACACCGACCCCGGTTGGAGCAACGGACTTC |
| 310 | 4953 | 1257 | GACATCCGGGTGACCCAGTCTCCATCCTCCCTGTCTGC ATCTGTAGGAGACAGAGTCACCATCACTTGCCGGGCA AGTCAGAGCATTAGCAGCTACTTAAATTGGTATCAAC AGAAACCAGGAAAAGCCCCTAAGCTCCTGATCTATGC TGCATCCACTTTGCAGAGGGGGGGCCCATCAAGATTC AGTGGCAGTGGATCTGGGACAGATTTCACTCTCAGCA TCAGCAGTCTGCAACCTGAAGATTTTGCAACTTACTAT TGTCAACAGACTTACATTATTCCATACACTTTTGGCCA GGGGACCAAGCTGGAGATCAAA |
| 310 | 4954 | 1258 | DIRVTQSPSSLSASVGDRVTITCRASQSISSYLNWYQQKP GKAPKLLIYAASTLQRGGPSRFSGSGSGTDFTLSISSLQPE DFATYYCQQTYIIPYTFGQGTKLEIK |
| 310 | 4955 | 1259 | RASQSISSYLN |
| 310 | 4956 | 1260 | CGGGCAAGTCAGAGCATTAGCAGCTACTTAAAT |
| 310 | 4957 | 1261 | AASTLQR |
| 310 | 4958 | 1262 | GCTGCATCCACTTTGCAGAGG |
| 310 | 4959 | 1263 | QQTYIIPYT |
| 310 | 4960 | 1264 | CAACAGACTTACATTATTCCATACACT |
| 311 | 4961 | 1265 | CAGGTGCAGCTGCAGGAGTCGGGCCCGGGACTGGTGA AGCCTTCGGAGACCCTGTCCCTCACCTGCAGTGTCTCT GGTGGCTCCATCACCAATGTTAATTACTACTGGGGCT |

TABLE 6-continued

Informal Sequence Listing

| Antibody No. | Seq. Ref. No. | SEQ ID NO. | Sequence |
|---|---|---|---|
| | | | GGATCCGCCAGCCCCCGGGAAGGGCCTGGAGTGGAT TGGGAGTATCTATTATAATGGAAACACCTACTACAAC CCGTCCCTCCAGAGTCGAGTCACCATGTCCGTGGACA CGTCCAAGAACCACTTCTCCCTGAGGCTGACGTCTGT GACCGCCGCAGACACGGCTGTATATTTTTGTGCGAGA GAGGGGCCTAATTGGGAATTGTTGAATGCTTTCGATA TCTGGGGCCAAGGGACCACGGTCACCGTCTCCTCA |
| 311 | 4962 | 1266 | QVQLQESGPGLVKPSETLSLTCSVSGGSITNVNYYWGWI RQPPGKGLEWIGSIYYNGNTYYNPSLQSRVTMSVDTSKN HFSLRLTSVTAADTAVYFCAREGPNWELLNAFDIWGQG TTVTVSS |
| 311 | 4963 | 1267 | GSITNVNYYWG |
| 311 | 4964 | 1268 | GGCTCCATCACCAATGTTAATTACTACTGGGGC |
| 311 | 4965 | 1269 | SIYYNGNTYYNPSLQS |
| 311 | 4966 | 1270 | AGTATCTATTATAATGGAAACACCTACTACAACCCGT CCCTCCAGAGT |
| 311 | 4967 | 1271 | AREGPNWELLNAFDI |
| 311 | 4968 | 1272 | GCGAGAGAGGGGCCTAATTGGGAATTGTTGAATGCTT TCGATATC |
| 311 | 4969 | 1273 | GACATCCAGGTGACCCAGCCACCCTCGGTGTCAGTGG CCCCAGGACAGACGGCCAGGATTACCTGTGGGGGAA ACAACATTGGAAGTAAAAATGTGCACTGGTACCAGCA GAAGCCAGGCCGGGCCCCTGTCTTGGTCGTCTATGAG GATACCCACCGGCCCTCAGGGATCCCTGAGCGATTCT CTGGCTCCAACTCTGGGAACACGGCCACCCTGACCAT CAGTAGGGTCGAAGCCGGGGATGAGGCCGACTATTAC TGTCAGGTGTGGGATACTAGTAGTGATCATGTGGTAT TCGGCGGAGGGACCAAGCTCACCGTCCTA |
| 311 | 4970 | 1274 | DIQVTQPPSVSVAPGQTARITCGGNNIGSKNVHWYQQKP GRAPVLVVYEDTHRPSGIPERFSGSNSGNTATLTISRVEA GDEADYYCQVWDTSSDHVVFGGGTKLTVL |
| 311 | 4971 | 1275 | GGNNIGSKNVH |
| 311 | 4972 | 1276 | GGGGGAAACAACATTGGAAGTAAAAATGTGCAC |
| 311 | 4973 | 1277 | EDTHRPS |
| 311 | 4974 | 1278 | GAGGATACCCACCGGCCCTCA |
| 311 | 4975 | 1279 | QVWDTSSDHVV |
| 311 | 4976 | 1280 | CAGGTGTGGGATACTAGTAGTGATCATGTGGTA |
| 312 | 4977 | 1281 | CAGGTCCAGCTGGTGCAGTCTGGGGGAGGCCTGGTCA AGCCTGAGGGGTCCCTGAGACTCTCCTGTGCAGCCTC TGGATTCACCTTCAGTAGCTATAGCATGAACTGGGTC CGCCAGGCTCCAGGGAAGGGGCTGGAGTGGGTCTCAT CCATTAGTAGTAGTAGTAGTTACATATACTACGCAGA CTCAGTGAAGGGCCGATTCACCATCTCCAGAGACAAC GCCAAGAACTCACTGTATCTGCAAATGAACAGCCTGA GAGCCGAGGACACGGCTGTGTATTACTGTGCGAGAGT CTCAACAGAATTGGGCTACTACTACATGGACGTCTGG GGCAAAGGGACCACGGTCACTGTCTCCTCA |
| 312 | 4978 | 1282 | QVQLVQSGGGLVKPEGSLRLSCAASGFTFSSYSMNWVR QAPGKGLEWVSSISSSSSYIYYADSVKGRFTISRDNAKNS LYLQMNSLRAEDTAVYYCARVSTELGYYYMDVWGKG TTVTVSS |
| 312 | 4979 | 1283 | FTFSSYSMN |
| 312 | 4980 | 1284 | TTCACCTTCAGTAGCTATAGCATGAAC |
| 312 | 4981 | 1285 | SISSSSSYIYYADSVKG |

TABLE 6-continued

Informal Sequence Listing

| Antibody No. | Seq. Ref. No. | SEQ ID NO. | Sequence |
|---|---|---|---|
| 312 | 4982 | 1286 | TCCATTAGTAGTAGTAGTAGTTACATATACTACGCAGACTCAGTGAAGGGC |
| 312 | 4983 | 1287 | ARVSTELGYYYMDV |
| 312 | 4984 | 1288 | GCGAGAGTCTCAACAGAATTGGGCTACTACTACATGGACGTC |
| 312 | 4985 | 1289 | CAGTCTGTCCTGACGCAGCCGCCCTCAGTGTCTGGGGCCCCAGGGCAGAGGGTCACCATCTCCTGCACTGGGAGCAGCTCCAACATCGGGGCAGGTTATGATGTACACTGGTACCAGCAGCTTCCAGGAACAGCCCCCAAACTCCTCATCTATGGTAACAGCAATCGGCCCTCAGGGGTCCCTGACCGATTCTCTGGCTCCAAGTCTGGCACCTCAGCCTCCCTGGCCATCACTGGGCTCCAGGCTGAGGATGAGGCTGATTATTACTGCCAGTCCTATGACAGCAGCCTGAGTGTGGTATTCGGCGGAGGGACCAAGCTGACCGTCCTA |
| 312 | 4986 | 1290 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL |
| 312 | 4987 | 1291 | TGSSSNIGAGYDVH |
| 312 | 4988 | 1292 | ACTGGGAGCAGCTCCAACATCGGGGCAGGTTATGATGTACAC |
| 312 | 4989 | 1293 | GNSNRPS |
| 312 | 4990 | 1294 | GGTAACAGCAATCGGCCCTCA |
| 312 | 4991 | 1295 | QSYDSSLSVV |
| 312 | 4992 | 1296 | CAGTCCTATGACAGCAGCCTGAGTGTGGTA |
| 313 | 4993 | 1297 | CAGGTCCAGCTTGTACAGTCTGGGGCTGAGGTGAAGAAGCCTGGGGCCTCAGTGAAGATTTCCTGCAAGGCTTCGGGATACCCCTTCAGTTCCTATCCTATGCATTGGGTGCGCCAGGCCCCCGGACAAAGGCTTGAGTGGATGGGATGGATCAACGTTGACAATGAGAACACAAAATATTCATGGAAGTTCCGGGGCAGAGTCACCATTACCAGGGACACATCCGCGAGCACAGTTTACATGGAGCTGAGCAGTCTGATATCTGAAGACACGGCTGTGTATTACTGTGGGAGAGACTGGGACGGGGCGATCCGTGTCTTGGACTACTGGGGCCAGGGAACCCTGGTCACCGTCTCCTCA |
| 313 | 4994 | 1298 | QVQLVQSGAEVKKPGASVKISCKASGYPFSSYPMHWVRQAPGQRLEWMGWINVDNENTKYSWKFRGRVTITRDTSASTVYMELSSLISEDTAVYYCGRDWDGAIRVLDYWGQGTLVTVSS |
| 313 | 4995 | 1299 | YPFSSYPMH |
| 313 | 4996 | 1300 | TACCCCTTCAGTTCCTATCCTATGCAT |
| 313 | 4997 | 1301 | WINVDNENTKYSWKFRG |
| 313 | 4998 | 1302 | TGGATCAACGTTGACAATGAGAACACAAAATATTCATGGAAGTTCCGGGGC |
| 313 | 4999 | 1303 | GRDWDGAIRVLDY |
| 313 | 5000 | 1304 | GGGAGAGACTGGGACGGGGCGATCCGTGTCTTGGACTAC |
| 313 | 5001 | 1305 | GATATTGTGATGACTCAGACTCCAGACTCCCTGGCTGTGTCTCTGGGCGAGAGGGCCACCATCACCTGCAAGTCCAGCCAGAGTGTTTTATTCAGCTCCGACAATAAGAACTACTTAGCTTGGTACCAGCAGAAACCGGGACAGCCTCCTAAATTGCTCATTTACTGGGCATCTATCCGGGAATCCGGGGTCCCTGACCGATTCGGTGGCAGGGGTCTGGACACATTTCACTCTCACCATCACCAGCGTGCAGGCTGCAGATGTGGCAGTTTATTACTGTCAGCAATATTATGGTAATTTCCCCACCTTCGGCCAAGGGACACGACTGGAGATTAAA |

TABLE 6-continued

Informal Sequence Listing

| Antibody No. | Seq. Ref. No. | SEQ ID NO. | Sequence |
|---|---|---|---|
| 313 | 5002 | 1306 | DIVMTQTPDSLAVSLGERATITCKSSQSVLFSSDNKNYLAWYQQKPGQPPKLLIYWASIRESGVPDRFGGSGSGTHFTLTITSVQAADVAVYYCQQYYGNFPTFGQGTRLEIK |
| 313 | 5003 | 1307 | KSSQSVLFSSDNKNYLA |
| 313 | 5004 | 008 | AAGTCCAGCCAGAGTGTTTTATTCAGCTCCGACAATAAGAACTACTTAGCT |
| 313 | 5005 | 1309 | WASIRES |
| 313 | 5006 | 1310 | TGGGCATCTATCCGGGAATCC |
| 313 | 5007 | 1311 | QQYYGNFPT |
| 313 | 5008 | 1312 | CAGCAATATTATGGTAATTTCCCCACC |
| 314 | 5009 | 1313 | CAGGTCCAGCTGGTGCAGTCTGGGGGAGGCGTGGTCCAGCCTGGGAGGTCCCTGAGACTTTCCTGTGCAGCCTCTGGATTCACCTTCAGAAACTATGGCATGCACTGGGTCCGCCAGGCTCCAGGCAAGGGGCTGGAGTGGGTAGCGGCTGCATCGTATGATGGGAGTAGTAAGTACTTTGCAGACGCCGTGAAGGGCCGATTCAGCATCTCCAGAGACAATACCAAGAACACGCTGTCTCTGCAAATGACCAGCCTGAGAGCTGAGGACACGGCTGTGTATTACTGTGCAAGAGACCCCGGAGTGGGAAGTTATTATAACGTGGTGGGTATGGACGTCTGGGGCCAAGGGACCACGGTCACCGTCTCCTCA |
| 314 | 5010 | 1314 | QVQLVQSGGGVVQPGRSLRLSCAASGFTFRNYGMHWVRQAPGKGLEWVAAASYDGSSKYFADAVKGRFSISRDNTKNTLSLQMTSLRAEDTAVYYCARDPGVGSYYNVVGMDVWGQGTTVTVSS |
| 314 | 5011 | 1315 | FTFRNYGMH |
| 314 | 5012 | 1316 | TTCACCTTCAGAAACTATGGCATGCAC |
| 314 | 5013 | 1317 | AASYDGSSKYFADAVKG |
| 314 | 5014 | 1318 | GCTGCATCGTATGATGGGAGTAGTAAGTACTTTGCAGACGCCGTGAAGGGC |
| 314 | 5015 | 1319 | ARDPGVGSYYNVVGMDV |
| 314 | 5016 | 1320 | GCAAGAGACCCCGGAGTGGGAAGTTATTATAACGTGGTGGGTATGGACGTC |
| 314 | 5017 | 1321 | GACATCCGGTTGACCCAGTCTCCACTCTCCCTGCCCGTCACCCTTGGACAGCCGGCCTCCATCTCCTGCAGGTCTAGTCAAAGCCTCGTATACAGTGATGGAAACACCTACTTGAATTGGTTTCAGCAGAGGCCAGGCCAATCTCCAAGGCGCCTAATTTATAGGGTTTCTCACCGGGACTCTGGGGTCCCAGACAGATTCAGCGGCAGTGAGTCAGGCACTGATTTCACACTGAAAATCAGCAGGGTGGAGGCTGAGGATGTTGGCGTTTATTACTGCATGCAAGGTACACACTGGCCTCCTACGTTCGGCCAAGGGACCAAGGTGGAGATCAAA |
| 314 | 5018 | 1322 | DIRLTQSPLSLPVTLGQPASISCRSSQSLVYSDGNTYLNWFQQRPGQSPRRLIYRVSHRDSGVPDRFSGSESGTDFTLKISRVEAEDVGVYYCMQGTHWPPTFGQGTKVEIK |
| 314 | 5019 | 1323 | RSSQSLVYSDGNTYLN |
| 314 | 5020 | 1324 | AGGTCTAGTCAAAGCCTCGTATACAGTGATGGAAACACCTACTTGAAT |
| 314 | 5021 | 1325 | RVSHRDS |
| 314 | 5022 | 1326 | AGGGTTTCTCACCGGGACTCT |
| 314 | 5023 | 1327 | MQGTHWPPT |
| 314 | 5024 | 1328 | ATGCAAGGTACACACTGGCCTCCTACG |

TABLE 6-continued

Informal Sequence Listing

| Antibody No. | Seq. Ref. No. | SEQ ID NO. | Sequence |
|---|---|---|---|
| 315 | 5025 | 1329 | CAGGTCCAGCTGGTGCAGTCTGGGGCTGAGGTGAAGA AGCCTGGGGCCTCAGTGAAGGTCGCCTGCAAGGTTTC CGGATCCAGCCTCACTGAATTGTCCATTCAATGGGTG CGCTTGCCTCCTGGCAAACGCCTTGAGTGGCTGGGAG CTTTTGATGCTGAAGATGGTGCACCAATCTACTCACCG AAATTCCAGGGCAGAGTCACCATGACCGAGGACAGAT CGACAGAGACAGCCTACATGGAGGTGACCAGCCTGA GATCTGAGGACACGGCCCTCTATTACTGTGCGACTCC CCTTCCCGCGGGAGCCCTTGACAAGTGGGGCCAGGGA ACCCTGGTCACCGTCTCCTCA |
| 315 | 5026 | 1330 | QVQLVQSGAEVKKPGASVKVACKVSGSSLTELSIQWVR LPPGKRLEWLGAFDAEDGAPIYSPKFQGRVTMTEDRSTE TAYMEVTSLRSEDTALYYCATPLPAGALDKWGQGTLVT VSS |
| 315 | 5027 | 1331 | SSLTELSIQ |
| 315 | 5028 | 1332 | TCCAGCCTCACTGAATTGTCCATTCAA |
| 315 | 5029 | 1333 | AFDAEDGAPIYSPKFQG |
| 315 | 5030 | 1334 | GCTTTTGATGCTGAAGATGGTGCACCAATCTACTCACC GAAATTCCAGGGC |
| 315 | 5031 | 1335 | ATPLPAGALDK |
| 315 | 5032 | 1336 | GCGACTCCCCTTCCCGCGGGAGCCCTTGACAAG |
| 315 | 5033 | 1337 | GACATCCAGATGACCCAGTCTCCATCCTCCCTGTCTGC TTCCGTAGGAGACAGAGTCACCATCTCTTGCCGGGCA AGTCAGACTATAAGCAGATATTTAAATTGGTATCAGG TCAAGCCAGGGACAGCCCCTAAGCTCCTAATCTACGC TGCATCCAGTTTGCAAACTGGGGTCCCATCAAGATTC AGTGCCAGTGGATCTGGGCAGATTTCACTCTCACCA TCAGCAGTCTGCAACCTGAAGATTTTGCGACTTACCA CTGTCAACAAACTTACATTATTCCGTACACTTTTGGCC AGGGGACCAAAGTGGATATCAAA |
| 315 | 5034 | 1338 | DIQMTQSPSSLSASVGDRVTISCRASQTISRYLNWYQVKP GTAPKLLIYAASSLQTGVPSRFSASGSGADFTLTISSLQPE DFATYHCQQTYIIPYTFGQGTKVDIK |
| 315 | 5035 | 1339 | RASQTISRYLN |
| 315 | 5036 | 1340 | CGGGCAAGTCAGACTATAAGCAGATATTTAAAT |
| 315 | 5037 | 1341 | AASSLQT |
| 315 | 5038 | 1342 | GCTGCATCCAGTTTGCAAACT |
| 315 | 5039 | 1343 | QQTYIIPYT |
| 315 | 5040 | 1344 | CAACAAACTTACATTATTCCGTACACT |
| 316 | 5041 | 1345 | GAGGTGCAGCTGGTGGAGTCGGGCCCAGGACTGGTGA AGCCTTCACAGACCCTGTCCCTCACCTGCACTGTCTCT GATGTCCTCATCAGCAGTGGTGATTACTACTGGAGTT GGATCCGCCAGTCCCCAGGGAAGGGCCTGGAGTGGCT TGGGTACATCTATTATACCGGGAAGACCAAATATAAT CCGTCCCTCGAGAGTCGAATTACCATGTCAGTAGACA CGTCCAAGAACCAGTTCTCCCTGAGGTTGAGCTCTGTT ACTGCCGCAGACACGGCCGTATATTTCTGTACCAGAG ATCTGGGATATAGCACCTCGTCCCCCTCCTTTTACTAT GGGATGGACGTCTGGGGCCAAGGGACCACGGTCACC GTCTCCTCA |
| 316 | 5042 | 1346 | EVQLVESGPGLVKPSQTLSLTCTVSDVLISSGDYYWSWI RQSPGKGLEWLGYIYYTGKTKYNPSLESRITMSVDTSKN QFSLRLSSVTAADTAVYFCTRDLGYSTSSPSFYYGMDV WGQGTTVTVSS |
| 316 | 5043 | 1347 | VLISSGDYYWS |
| 316 | 5044 | 1348 | GTCCTCATCAGCAGTGGTGATTACTACTGGAGT |

TABLE 6-continued

Informal Sequence Listing

| Antibody No. | Seq. Ref. No. | SEQ ID NO. | Sequence |
|---|---|---|---|
| 316 | 5045 | 1349 | YIYYTGKTKYNPSLES |
| 316 | 5046 | 1350 | TACATCTATTATACCGGGAAGACCAAATATAATCCGT CCCTCGAGAGT |
| 316 | 5047 | 1351 | TRDLGYSTSSPSFYYGMDV |
| 316 | 5048 | 1352 | ACCAGAGATCTGGGATATAGCACCTCGTCCCCCTCCTT TTACTATGGGATGGACGTC |
| 316 | 5049 | 1353 | GAAATTGTGTTGACACAGTCTCCAGCCACCCTGTCTTT GTCTCCAGGGGAAAGAGCCACCCTCTCCTGCAGGGCC AGTCAGAGTGTTGGGACCTACTTAGCCTGGTACCAAC AGAAACCTGGCCAGGCTCCCAGGCTCCTCATCTATGA TGCATCTTACAGGGTCACTGGCATCCCAGCCAGGTTC AGTGCCAGTGGGTCTGCGACAGACTTCACTCTCACCA TCAGCAGCCTAGAGCCTGAAGATTTTGCAGTTTATTTC TGTCAGCAGCGTACCAACTGGCCGATCACCTTCGGCC AGGGGACACGACTGGAGATTAAA |
| 316 | 5050 | 1354 | EIVLTQSPATLSLSPGERATLSCRASQSVGTYLAWYQQK PGQAPRLLIYDASYRVTGIPARFSASGSATDFTLTISSLEP EDFAVYFCQQRTNWPITFGQGTRLEIK |
| 316 | 5051 | 1355 | RASQSVGTYLA |
| 316 | 5052 | 1356 | AGGGCCAGTCAGAGTGTTGGGACCTACTTAGCC |
| 316 | 5053 | 1357 | DASYRVT |
| 316 | 5054 | 1358 | GATGCATCTTACAGGGTCACT |
| 316 | 5055 | 1359 | QQRTNWPIT |
| 316 | 5056 | 1360 | CAGCAGCGTACCAACTGGCCGATCACC |
| 317 | 5057 | 1361 | CAGGTCCAGCTTGTGCAGTCTGGACCTGAGGTGAAGA AGCCTGGGGCCTCAGTGACGGTCTCCTGCAAGGCTTC CGGTTACACCTTTAGCCATTACGGTATTAGTTGGGTGC GACAGGCCCCTGGACAAGGGCTTGAGTGGATGGGGTG GATCAGCGCGTACCATGGTCAGACAAACTATGCACAG AACTTCCAGGGCAGAGTCACCATGACCACAGACACAT CCTCGAACACAGCCTACATGGAGGTCAGGAGCCTGAG ATCTGACGACACGGCCGTTTATTTCTGTGCGAGAGAT GTCTTTTCGAAAACAGCAGCTCGAATCTTTGACTACTG GGGCCAGGGAACCCTGGTCACCGTCTCCTCA |
| 317 | 5058 | 1362 | QVQLVQSGPEVKKPGASVTVSCKASGYTFSHYGISWVR QAPGQGLEWMGWISAYHGQTNYAQNFQGRVTMTTDTS SNTAYMEVRSLRSDDTAVYFCARDVFSKTAARIFDYWG QGTLVTVSS |
| 317 | 5059 | 1363 | YTFSHYGIS |
| 317 | 5060 | 1364 | TACACCTTTAGCCATTACGGTATTAGT |
| 317 | 5061 | 1365 | WISAYHGQTNYAQNFQG |
| 317 | 5062 | 066 | TGGATCAGCGCGTACCATGGTCAGACAAACTATGCAC AGAACTTCCAGGGC |
| 317 | 5063 | 1367 | ARDVFSKTAARIFDY |
| 317 | 5064 | 1368 | GCGAGAGATGTCTTTTCGAAAACAGCAGCTCGAATCT TTGACTAC |
| 317 | 5065 | 1369 | GAAATTGTATTGACGCAGTCTCCACTCTCCCTGCCCGT CACCCTTGGACAGCCGGCCTCCATCTCCTGCAGGTCTA GTCAAAGCCTCGAATATAGTGACGGAAACACCTACTT GAGTTGGTTTCAGCAGAGGCCAGGCCAATCTCCAAGG CGCCTAATTTATAAGGTTTCTAACCGGGACTCTGGGGT CCCAGACAGATTCAGCGGCAGTCAGTCAGGCACTGAT TTCACACTGAAAATCAGCAGGGTGGAGGCTGAGGATG TTGGGGTTTATTACTGCATGCAAGCTACAGACTGGCC GGTCACGTTCGGCCAAGGGACCAAGCTGGAGATCAAA |

TABLE 6-continued

Informal Sequence Listing

| Antibody No. | Seq. Ref. No. | SEQ ID NO. | Sequence |
|---|---|---|---|
| 317 | 5066 | 1370 | EIVLTQSPLSLPVTLGQPASISCRSSQSLEYSDGNTYLSWF QQRPGQSPRRLIYKVSNRDSGVPDRFSGSQSGTDFTLKIS RVEAEDVGVYYCMQATDWPVTFGQGTKLEIK |
| 317 | 5067 | 1371 | RSSQSLEYSDGNTYLS |
| 317 | 5068 | 1372 | AGGTCTAGTCAAAGCCTCGAATATAGTGACGGAAACA CCTACTTGAGT |
| 317 | 5069 | 1373 | KVSNRDS |
| 317 | 5070 | 1374 | AAGGTTTCTAACCGGGACTCT |
| 317 | 5071 | 1375 | MQATDWPVT |
| 317 | 5072 | 1376 | ATGCAAGCTACAGACTGGCCGGTCACG |
| 318 | 5073 | 1377 | CAGGTGCAGCTGCAGGAGTCGGGCCCAAGACTGGTGA AGCCTTCGCAGACCCTGTCCCTCACCTGCACTGTCTCT GGTGGCTCCATCAGCAGTGGTGATTATTACTGGAGTT GGATCCGCCAGCCCCCAGGGAAGGGCCTGGAGTGGAT TGGGTACATCTATTACAGTGGGAGCACCCACTACAAC CCGTCCCTCAAGAGTCGAGTTAGCATGTCAGTAGACA CGGCCAAGAACCAGTTCTCCCTGAAGCTGACCTCTGT GACTGCCGCAGACACGGCCGTCTATTACTGTGCCAGA GATATCGGCTACGGTGACCACGGGACTGGGTCTTATT ACTACGGAATAGAAGACTGGGGCCAAGGGACCACGG TCACCGTCTCCTCA |
| 318 | 5074 | 1378 | QVQLQESGPRLVKPSQTLSLTCTVSGGSISSGDYYWSWI RQPPGKGLEWIGYIYYSGSTHYNPSLKSRVSMSVDTAKN QFSLKLTSVTAADTAVYYCARDIGYGDHGTSYYYGIE DWGQGTTVTVSS |
| 318 | 5075 | 1379 | GSISSGDYYWS |
| 318 | 5076 | 1380 | GGCTCCATCAGCAGTGGTGATTATTACTGGAGT |
| 318 | 5077 | 1381 | YIYYSGSTHYNPSLKS |
| 318 | 5078 | 1382 | TACATCTATTACAGTGGGAGCACCCACTACAACCCGT CCCTCAAGAGT |
| 318 | 5079 | 1383 | ARDIGYGDHGTSYYYGIED |
| 318 | 5080 | 1384 | GCCAGAGATATCGGCTACGGTGACCACGGGACTGGGT CTTATTACTACGGAATAGAAGAC |
| 318 | 5081 | 1385 | GATATTGTGATGACTCAGACTCCAGCCACCCTGTCTTT GTCTCCAGGGGACAGAGCCACCCTCTCCTGCAGGGCC AGTCAGAATATTATGAGCTACTTAGCCTGGTACCAAC ACAAACCTGGCCAGCCTCCCAGGCTCCTCATCTATGA TGCATCCTACAGGGCCGCTGGCATCCCAGCCAGGTTC AGTGGCAGTGGGTCTGGGACAGACTTCACTCTCACCA TCAGCAGCCTAGAGCCTGAAGATTTTGCAGTTTATTAC TGTCAGCAGCGAACCAACTGGATCACCTTCGGCCAAG GGACACGACTGGAGATTAAA |
| 318 | 5082 | 1386 | DIVMTQTPATLSLSPGDRATLSCRASQNIMSYLAWYQH KPGQPPRLLIYDASYRAAGIPARFSGSGSGTDFTLTISSLE PEDFAVYYCQQRTNWITFGQGTRLEIK |
| 318 | 5083 | 1387 | RASQNIMSYLA |
| 318 | 5084 | 1388 | AGGGCCAGTCAGAATATTATGAGCTACTTAGCC |
| 318 | 5085 | 1389 | DASYRAA |
| 318 | 5086 | 1390 | GATGCATCCTACAGGGCCGCT |
| 318 | 5087 | 1391 | QQRTNWIT |
| 318 | 5088 | 1392 | CAGCAGCGAACCAACTGGATCACC |

TABLE 6-continued

Informal Sequence Listing

| Antibody No. | Seq. Ref. No. | SEQ ID NO. | Sequence |
|---|---|---|---|
| 319 | 5089 | 1393 | GAGGTGCAGCTGGTGGAGTCAGGGGGAGGCTTGGTGC AGCGGGGGGGTCCCTGAGACTCTCGTGTGCGGCCTC TGGATTCACCTTTAGTGGTAATGCCATGAGCTGGGTCC GCCAGGCTCCAGGGAAGGGGCTGGAGTGGGTCGCATC TATTGGTGAAAGTGCTACTAGCGCATACTACGCAGAC TCCGTGAAGGGCCGGTTCACCATCTCCAGAGATGATT CGAAGAACACTCTGTATCTCCAAATGAACAGCCTGAG ACCCGAGGACACGGCCGTATATTTCTGTGCGAAAGAT CGCGTAGGATGGTTCGGGGAGTTCGACGCTTTTGATTT CTGGGGCCAAGGGACAATGGTCACCGTCTCTTCA |
| 319 | 5090 | 1394 | EVQLVESGGGLVQRGGSLRLSCAASGFTFSGNAMSWVR QAPGKGLEWVASIGESATSAYYADSVKGRFTISRDDSKN TLYLQMNSLRPEDTAVYFCAKDRVGWFGEFDAFDFWG QGTMVTVSS |
| 319 | 5091 | 1395 | FTFSGNAMS |
| 319 | 5092 | 1396 | TTCACCTTTAGTGGTAATGCCATGAGC |
| 319 | 5093 | 1397 | SIGESATSAYYADSVKG |
| 319 | 5094 | 1398 | TCTATTGGTGAAAGTGCTACTAGCGCATACTACGCAG ACTCCGTGAAGGGC |
| 319 | 5095 | 1399 | AKDRVGWFGEFDAFDF |
| 319 | 5096 | 1400 | GCGAAAGATCGCGTAGGATGGTTCGGGGAGTTCGACG CTTTTGATTTC |
| 319 | 5097 | 1401 | TCCTATGAGCTGACGCAGCCACCCTCAGTGTCAGTGG CCCCAGGAAAGACGGCCACCATTTCCTGTGGGGGAAA CAACATTGGAGGTCACAAAGTGCACTGGTACCAGCAG AGGCCAGGCCAGGCCCCTGTCTTGGTCATCTATTATG ATAACGTCCGGCCCTCAGGGATCCCTGAGCGATTCTC TGGCTCCAACTCTGGAAACACGGCCACCCTGACCATC AGCAGGGTCGAGGCCGGGGATGAGGCCGACTTTTACT GTCAGGTGTGGGATAGTCGTTCTGAACATGTCATATTC GGCGGGGGGACCAAGGTCACCGTCCTA |
| 319 | 5098 | 1402 | SYELTQPPSVSVAPGKTATISCGGNNIGGHKVHWYQQRP GQAPVLVIYYDNVRPSGIPERFSGSNSGNTATLTISRVEA GDEADFYCQVWDSRSEHVIFGGGTKVTVL |
| 319 | 5099 | 1403 | GGNNIGGHKVH |
| 319 | 5100 | 1404 | GGGGGAAACAACATTGGAGGTCACAAAGTGCAC |
| 319 | 5101 | 1405 | YDNVRPS |
| 319 | 5102 | 1406 | TATGATAACGTCCGGCCCTCA |
| 319 | 5103 | 1407 | QVWDSRSEHVI |
| 319 | 5104 | 1408 | CAGGTGTGGGATAGTCGTTCTGAACATGTCATA |
| 320 | 5105 | 1409 | CAGGTCCAGCTTGTACAGTCTGGAGCTGAGGTGAAGA AGCCTGGGGCCTCAGTGAAGGTCTCGTGCAAGACTTC TGGTTACACCTTTTCCAACTACGGTATCAGCTGGCTGC GACAGGCCCCTGGACAAGGGCTTGAGTGGATGGCATG GATCAGCCCTTATAATGGGAACACAAAGTCTGCACAG AGGTTTCAGGGCAGAGTCATCATGACCACAGACACAT CCACGAGGACAGCCCACATGGAGGTGAAGAGCCTGA GAACTGACGACACGGCCACATATTACTGTGCGAGAGA TCCAGCAGTCGATGCAATACCGATGCTTGACTACTGG GGCCAGGGAACCCTGGTCACCGTCTCCTCA |
| 320 | 5106 | 1410 | QVQLVQSGAEVKKPGASVKVSCKTSGYTFSNYGISWLR QAPGQGLEWMAWISPYNGNTKSAQRFQGRVIMTTDTST RTAHMEVKSLRTDDTATYYCARDPAVDAIPMLDYWGQ GTLVTVSS |
| 320 | 5107 | 1411 | YTFSNYGIS |
| 320 | 5108 | 1412 | TACACCTTTTCCAACTACGGTATCAGC |

TABLE 6-continued

Informal Sequence Listing

| Antibody No. | Seq. Ref. No. | SEQ ID NO. | Sequence |
|---|---|---|---|
| 320 | 5109 | 1413 | WISPYNGNTKSAQRFQG |
| 320 | 5110 | 1414 | TGGATCAGCCCTTATAATGGGAACACAAAGTCTGCACAGAGGTTTCAGGGC |
| 320 | 5111 | 1415 | ARDPAVDAIPMLDY |
| 320 | 5112 | 1416 | GCGAGAGATCCAGCAGTCGATGCAATACCGATGCTTGACTAC |
| 320 | 5113 | 1417 | GACATCCAGATGACCCAGTCTCCACTCTCCCTGCCCGTCACCCTTGGACAGCCGGCCTCCATCTCCTGCAGGTCTAGTCAAAGCCTCGTGTACACTGATGGAAACACCTACTTGAGCTGGTTTCAGCAGAGGCCAGGCCAATCTCCAAGGCGCCTAATTTATAGGGTTTCTCACCGGGACTCTGGGGTCCCAGACAGATTCACCGGCAGTGGGTCAGGCACTGATTTCACACTGATAATCCGCAGGGTGGAGGCTGAGGATGTTGGGGTTTATTACTGCATGCAAGGTACACACTGGCCTCTCACTTTCGGCGGAGGGACCAAGCTGGAGATCAAA |
| 320 | 5114 | 1418 | DIQMTQSPLSLPVTLGQPASISCRSSQSLVYTDGNTYLSWFQQRPGQSPRRLIYRVSHRDSGVPDRFTGSGSGTDFTLIIRRVEAEDVGVYYCMQGTHWPLTFGGGTKLEIK |
| 320 | 5115 | 1419 | RSSQSLVYTDGNTYLS |
| 320 | 5116 | 1420 | AGGTCTAGTCAAAGCCTCGTGTACACTGATGGAAACACCTACTTGAGC |
| 320 | 5117 | 1421 | RVSHRDS |
| 320 | 5118 | 1422 | AGGGTTTCTCACCGGGACTCT |
| 320 | 5119 | 1423 | MQGTHWPLT |
| 320 | 5120 | 1424 | ATGCAAGGTACACACTGGCCTCTCACT |
| 321 | 5121 | 1425 | CAGGTCCAGCTGGTACAGTCTGGTCCTGCGCTGGTGAAACCCACACAGACCCTCACACTGACCTGCACCTTCGGTGGATTCTCACTCAGCAGACATGGAATGCGTGTGACCTGGATCCGTCAGGCCCCCGGGAAGGCCCTGGAGTGGCTTGGTCACATTGATTGGGATGATGATAAATTCTACAGGACATCTCTGAAGACCAGGCTCACCATCTCCAAGGACCCCTCTAACAATGAGGTGGTCCTGAAAATGACCAACATGGACCACGTGGACACAGCCACGTATTACTGTGCACTGATGAGGCCCTTTTGGAGTCGTGACGACTACTACTATTCCATCGCCGTCTGGGGCAAAGGGACCACGGTCACCGTCTCCTCA |
| 321 | 5122 | 1426 | QVQLVQSGPALVKPTQTLTLTCTFGGFSLSRHGMRVTWIRQAPGKALEWLGHIDWDDDKFYRTSLKTRLTISKDPSNNEVVLKMTNMDHVDTATYYCALMRPFWSRDDYYYSIAVWGKGTTVTVSS |
| 321 | 5123 | 1427 | FSLSRHGMRVT |
| 321 | 5124 | 1428 | TTCTCACTCAGCAGACATGGAATGCGTGTGACC |
| 321 | 5125 | 1429 | HIDWDDDKFYRTSLKT |
| 321 | 5126 | 1430 | CACATTGATTGGGATGATGATAAATTCTACAGGACATCTCTGAAGACC |
| 321 | 5127 | 1431 | ALMRPFWSRDDYYYSIAV |
| 321 | 5128 | 1432 | GCACTGATGAGGCCCTTTTGGAGTCGTGACGACTACTACTATTCCATCGCCGTC |
| 321 | 5129 | 1433 | GATATTGTGCTGACCCAGTCTCCAGGCACCCTGTCTTTGTCTCCAGGGGACAGAGCCACCCTCTCCTGCAGGGCCAGTCAGAGTGTCGGCAGCGGCTACGTAACCTGGTACCAGCAGAAACCTGGCCAGGCTCCCAGGCTCCTCATTTATGGTGCATCAAACAGGGCCGAAGGCATCCCAGACAGGTTCAGTGGCAGTGGGTCTGGGACAGACTTCACTCTCACCATCAGCGGACTGGAGTCTGAAGATTTTGTAATTT |

TABLE 6-continued

Informal Sequence Listing

| Antibody No. | Seq. Ref. No. | SEQ ID NO. | Sequence |
|---|---|---|---|
| | | | ATTACTGTCAGCTATATCATAGGTCACCTGGCTCTGCG<br>AGTCAAACCGTTTGGACGTTCGGCCAAGGGACCAAGG<br>TGGAAATCAAA |
| 321 | 5130 | 1434 | DIVLTQSPGTLSLSPGDRATLSCRASQSVGSGYVTWYQQ<br>KPGQAPRLLIYGASNRAEGIPDRFSGSGSTDFTLTISGLE<br>SEDFVIYYCQLYHRSPGSASQTVWTFGQGTKVEIK |
| 321 | 5131 | 1435 | RASQSVGSGYVT |
| 321 | 5132 | 1436 | AGGGCCAGTCAGAGTGTCGGCAGCGGCTACGTAACC |
| 321 | 5133 | 1437 | GASNRAE |
| 321 | 5134 | 1438 | GGTGCATCAAACAGGGCCGAA |
| 321 | 5135 | 1439 | QLYHRSPGSASQTVWT |
| 321 | 5136 | 1440 | CAGCTATATCATAGGTCACCTGGCTCTGCGAGTCAAA<br>CCGTTTGGACG |
| 322 | 5137 | 1441 | CAGGTCCAGCTTGTACAGTCTGGACCTGAGGTGAAGA<br>AGCCTGGGGCCTCAGTGAGGGTCTCCTGCGAGGCTTC<br>TGGTTACCCCTTTAGCAATTACGGCATCACCTGGGTGC<br>GCCAGGCCCCTGGACAAGGGCTTGAGTGGATGGGATG<br>GATCAGCGCTTACAACGGAAACAGAGACTATCTGCAG<br>AAGTTTCAGGGCAGACTCACCATGACCATAGACACAT<br>CCACGAGAACAGCCCACATGGAATTGAGGCGCCTGAC<br>ATCTGACGACACGGCCGTATATTGGTGTGCGAGAGAC<br>ACACCCGCCACTGCTGCCCCTCTGCTTGACTACTGGGG<br>CCAGGGAACCCTGGTCACCGTCTCCTCA |
| 322 | 5138 | 1442 | QVQLVQSGPEVKKPGASVRVSCEASGYPFSNYGITWVR<br>QAPGQGLEWMGWISAYNGNRDYLQKFQGRLTMTIDTS<br>TRTAHMELRRLTSDDTAVYWCARDTPATAAPLLDYWG<br>QGTLVTVSS |
| 322 | 5139 | 1443 | YPFSNYGIT |
| 322 | 5140 | 1444 | TACCCCTTTAGCAATTACGGCATCACC |
| 322 | 5141 | 1445 | WISAYNGNRDYLQKFQG |
| 322 | 5142 | 1446 | TGGATCAGCGCTTACAACGGAAACAGAGACTATCTGC<br>AGAAGTTTCAGGGC |
| 322 | 5143 | 1447 | ARDTPATAAPLLDY |
| 322 | 5144 | 1448 | GCGAGAGACACACCCGCCACTGCTGCCCCTCTGCTTG<br>ACTAC |
| 322 | 5145 | 1449 | GATATTGTGATGACTCAGTCTCCACTCTCCCTGGCCGT<br>CACCCTTGGACAGCCGGCCTCCATCTCCTGCAGGTCTA<br>GTCAAAGCCTCGAATTCACTGATGGAAACACCTACTT<br>GAATTGGTTTCAGCAGAGGCCAGGCCAATCTCCAAGG<br>CGCCTAATTTATAAGGTTTCTAACCGGGACTCTGGGGT<br>CCCAGACAGATTCAGCGGCAGTGGGTCAGGCACTGGT<br>TTCACACTGAAAATCAGCAGGGTGGAGGCTGAGGATG<br>TTGGGGTTTATTACTGCATGCAAGGTATTTTCCGGCCG<br>GGGACGTTCGGCCAAGGGACCAAGGTGGAAATCAAA |
| 322 | 5146 | 1450 | DIVMTQSPLSLAVTLGQPASISCRSSQSLEFTDGNTYLNW<br>FQQRPGQSPRRLIYKVSNRDSGVPDRFSGSGSTGFTLKI<br>SRVEAEDVGVYYCMQGIFRPGTFGQGTKVEIK |
| 322 | 5147 | 1451 | RSSQSLEFTDGNTYLN |
| 322 | 5148 | 1452 | AGGTCTAGTCAAAGCCTCGAATTCACTGATGGAAACA<br>CCTACTTGAAT |
| 322 | 5149 | 1453 | KVSNRDS |
| 322 | 5150 | 1454 | AAGGTTTCTAACCGGGACTCT |
| 322 | 5151 | 1455 | MQGIFRPGT |

TABLE 6-continued

Informal Sequence Listing

| Antibody No. | Seq. Ref. No. | SEQ ID NO. | Sequence |
|---|---|---|---|
| 322 | 5152 | 1456 | ATGCAAGGTATTTTCCGGCCGGGGACG |
| 323 | 5153 | 1457 | CAGGTCCAGCTGGTGCAGTCTGGAGCTGAGGTGAAGA AGCCTGGGGCCTCAGTGAAGGTCTCCTGCAAGGCTTC TGGTTACACCTTTGTCCACTATGGTATCAGTTGGGTGC GACAGGCCCCTGGACAAGGGCTTGAGTGGATGGGATG GATCAGCGCATACAATGGTAATACAAACTCTGCACTG AAGTTCCAGGACAGAGTCACCATGACCACAGACCCAT CCACGAGCACAGCCTACATGGAGCTGAGGAGCCTGAG ATCTGACGACACGGCCATTTATTACTGTGCGAGAGAC TCAGGTTGTTGTAGTGGTTCCACCTCAGACGTCTGGGG CAAAGGGACCACGGTCACCGTCTCCTCA |
| 323 | 5154 | 1458 | QVQLVQSGAEVKKPGASVKVSCKASGYTFVHYGISWVR QAPGQGLEWMGWISAYNGNTNSALKFQDRVTMTTDPS TSTAYMELRSLRSDDTAIYYCARDSGCCSGSTSDVWGK GTTVTVSS |
| 323 | 5155 | 1459 | YTFVHYGIS |
| 323 | 5156 | 1460 | TACACCTTTGTCCACTATGGTATCAGT |
| 323 | 5157 | 1461 | WISAYNGNTNSALKFQD |
| 323 | 5158 | 1462 | TGGATCAGCGCATACAATGGTAATACAAACTCTGCAC TGAAGTTCCAGGAC |
| 323 | 5159 | 1463 | ARDSGCCSGSTSDV |
| 323 | 5160 | 1464 | GCGAGAGACTCAGGTTGTTGTAGTGGTTCCACCTCAG ACGTC |
| 323 | 5161 | 1465 | GATATTGTGATGACTCAGTCTCCACTCTCTTCACCTGT CACCCTTGGACAGCCGGCCTCCATCTCCTGCAGGTCTA GTCAAAGCCTCGTGCACAGTGATGGAAACACCTACTT GAGTTGGCTTCACCAGAGGCCAGGCCAGCCTCCAAGA CTCCTAATTTATAAGATTTCCCACCGGTTCTCTGGGGT CCCAGACAGATTCACTGGCAGTGGGGCAGGGACAGAT TTCACACTGAAAATCAGCAGGGTGGAGGCTGAGGATG TCGGGGTTTATTACTGCATGCAAGCTACAGAATTTCCT CCGATGTACACTTTTGGCCAGGGGACCAAGGTGGAGA TCAAA |
| 323 | 5162 | 1466 | DIVMTQSPLSSPVTLGQPASISCRSSQSLVHSDGNTYLSW LHQRPGQPPRLLIYKISHRFSGVPDRFTGSGAGTDFTLKIS RVEAEDVGVYYCMQATEFPPMYTFGQGTKVEIK |
| 323 | 5163 | 1467 | RSSQSLVHSDGNTYLS |
| 323 | 5164 | 1468 | AGGTCTAGTCAAAGCCTCGTGCACAGTGATGGAAACA CCTACTTGAGT |
| 323 | 5165 | 1469 | KISHRFS |
| 323 | 5166 | 1470 | AAGATTTCCCACCGGTTCTCT |
| 323 | 5167 | 1471 | MQATEFPPMYT |
| 323 | 5168 | 1472 | ATGCAAGCTACAGAATTTCCTCCGATGTACACT |
| 324 | 5169 | 1473 | GAGGTGCAGCTGGTGGAGACGGGCCCAGGACTGGTG AAGCCTTCGGAGACCCTGTCCCTCACCTGCACTGTCTC TGGTGACTCCATCAGTGGTTACTACTGGAGCTGGATC CGGCAGTCCCCAGGGAAGGGACTGGAGTGGATTGGCT ATATCTATTACAGGGGGAGCACCGACTACAACCCCTC CCTCAAGAGTCGAGTCACCATATCAGTAGACACGTCC AAGAACCAGTTCTCCCTGAAACTGAGCTCTGTGACCG CTGCGGACACGGCCGTGTATTACTGTGCGAGAGATAA TAAACACCATGATTCGGGAAATTATTACGCATACTTT GACCATTGGGGCCAGGGAACCCTGGTCACCGTCTCCT CA |

TABLE 6-continued

Informal Sequence Listing

| Antibody No. | Seq. Ref. No. | SEQ ID NO. | Sequence |
|---|---|---|---|
| 324 | 5170 | 1474 | EVQLVETGPGLVKPSETLSLTCTVSGDSISGYYWSWIRQSPGKGLEWIGYIYYRGSTDYNPSLKSRVTISVDTSKNQFSLKLSSVTAADTAVYYCARDNKHHDSGNYYAYFDHWGQGTLVTVSS |
| 324 | 5171 | 1475 | DSISGYYWS |
| 324 | 5172 | 1476 | GACTCCATCAGTGGTTACTACTGGAGC |
| 324 | 5173 | 1477 | YIYYRGSTDYNPSLKS |
| 324 | 5174 | 1478 | TATATCTATTACAGGGGGAGCACCGACTACAACCCCTCCCTCAAGAGT |
| 324 | 5175 | 1479 | ARDNKHHDSGNYYAYFDH |
| 324 | 5176 | 1480 | GCGAGAGATAATAAACACCATGATTCGGGAAATTATTACGCATACTTTGACCAT |
| 324 | 5177 | 1481 | GATATTGTGATGACTCAGTCTCCATCCTCCCTGTCTGCATCTGTAGGAGACAGAGTCACCATCACTTGCCGGGCAAGTCAGAACATTAACACCTTTTTAAATTGGTATCAGCACAAACCAGGGAAAGCCCCTAAACTCCTGATCTATGGTGCATCCCGTTTGCAGAGTGGGGTCCCATCAAGGTTCACTGGCAGTGGATCTGGGACAGATTTCACTCTCACCATCAGCAGTCTGCAACCTGAAGATTTTGCAACTTACTCCTGTCAACAGAGTTACACTACCCGGCTCACTTTCGGCGGAGGGACCAAGGTGGAAATCAAA |
| 324 | 5178 | 1482 | DIVMTQSPSSLSASVGDRVTITCRASQNINTFLNWYQHKPGKAPKLLIYGASRLQSGVPSRFTGSGSGTDFTLTISSLQPEDFATYSCQQSYTTRLTFGGGTKVEIK |
| 324 | 5179 | 1483 | RASQNINTFLN |
| 324 | 5180 | 1484 | CGGGCAAGTCAGAACATTAACACCTTTTTAAAT |
| 324 | 5181 | 1485 | GASRLQS |
| 324 | 5182 | 1486 | GGTGCATCCCGTTTGCAGAGT |
| 324 | 5183 | 1487 | QQSYTTRLT |
| 324 | 5184 | 1488 | CAACAGAGTTACACTACCCGGCTCACT |
| 325 | 5185 | 1489 | CAGGTCCAGCTGGTGCAGTCTGGGACTGAGGTGAAGAAGCCTGGGGCCTCAGTGAAGATTTCCTGCAAGACTTCTGGATACACCTTCACTAATAATGTAATTCAATGGGTGCGCCAGGCCCCCGGACAAAGGCTTGAGTGGATGGGATGGATCAGCGCTGGCAATGGTTACACAAAATATTCAGACAAGTTCCAGGACAGAGTCACCATTACCAGGGACACATCCGCGAGCACAGCCTACATGGAGGTGAGCAGCCTGACATCTGAAGACACGGCTATGTATTACTGTGCGAGACAAGTCTCGACTAGTGGCTGGCACGCAACGTCACACCGGTTCGCCCCCTGGGGCCAGGGAACCCTGGTCACCGTCTCCTCA |
| 325 | 5186 | 1490 | QVQLVQSGTEVKKPGASVKISCKTSGYTFTNNVIQWVRQAPGQRLEWMGWISAGNGYTKYSDKFQDRVTITRDTSASTAYMEVSSLTSEDTAMYYCARQVSTSGWHATSHRFAPWGQGTLVTVSS |
| 325 | 5187 | 1491 | YTFTNNVIQ |
| 325 | 5188 | 1492 | TACACCTTCACTAATAATGTAATTCAA |
| 325 | 5189 | 1493 | WISAGNGYTKYSDKFQD |
| 325 | 5190 | 1494 | TGGATCAGCGCTGGCAATGGTTACACAAAATATTCAGACAAGTTCCAGGAC |
| 325 | 5191 | 1495 | ARQVSTSGWHATSHRFAP |
| 325 | 5192 | 1496 | GCGAGACAAGTCTCGACTAGTGGCTGGCACGCAACGTCACACCGGTTCGCCCCC |

TABLE 6-continued

Informal Sequence Listing

| Antibody No. | Seq. Ref. No. | SEQ ID NO. | Sequence |
|---|---|---|---|
| 325 | 5193 | 1497 | GACATCCAGATGACCCAGTCTCCATCCTCCCTGTCTGC<br>ATCTGTAGGAGACAGAGTCACCATCACTTGCCAGGCG<br>AGTCAGGGCATTAGTAGATATTTAAATTGGTATCAGC<br>AGAAACCAGGGAAAGCCCCTAACCTCCTGATCTACGA<br>TGCATCCAATTTGGAAACAGGGGTCCCATCAAGGTTC<br>AGTGGAAGTGGATCTGGGACACATTTTACTTTAACCA<br>TCAGCAGCCTGCAGCCTGAAGATATTGCAACATATTA<br>CTGTCAACAGTATGATAATCTCCCGCTCACTTTCGGCG<br>GAGGGACCAAGGTGGAAATCAAA |
| 325 | 5194 | 1498 | DIQMTQSPSSLSASVGDRVTITCQASQGISRYLNWYQQK<br>PGKAPNLLIYDASNLETGVPSRFSGSGSGTHFTLTISSLQP<br>EDIATYYCQQYDNLPLTFGGGTKVEIK |
| 325 | 5195 | 1499 | QASQGISRYLN |
| 325 | 5196 | 1500 | CAGGCGAGTCAGGGCATTAGTAGATATTTAAAT |
| 325 | 5197 | 1501 | DASNLET |
| 325 | 5198 | 1502 | GATGCATCCAATTTGGAAACA |
| 325 | 5199 | 1503 | QQYDNLPLT |
| 325 | 5200 | 1504 | CAACAGTATGATAATCTCCCGCTCACT |
| 326 | 5201 | 1505 | GAGGTGCAGCTGGTGGAGTCTGGGGGAGGCGTGGTCC<br>AGCCTGGGAGGTCCCTGAGACTCTCCTGTGAAGCCTC<br>TGGATTCACCTTCAGTAGTTTTAGCATGCACTGGGTCC<br>GCCAGGCTCCGGGCAAGGGGCTGGAGTGGGTGGCAG<br>TGATTTTATATGATGGGAGTAATCAATACTATGCAGA<br>CTCCGTGAAGGGCCGATTCACCATCTCCAGAGACAAT<br>TCCAAGAACACGCTTTATCTGCAAATGAACACCCTGA<br>GAGCTGAGGACACGGCTATGTATTACTGTGCGAAATC<br>ATCATCGTCCCATGTTAACTCTCGACAAGACAAATGG<br>GGCCAGGGCACCCTGGTCACCGTCTCCTCA |
| 326 | 5202 | 1506 | EVQLVESGGGVVQPGRSLRLSCEASGFTFSSFSMHWVR<br>QAPGKGLEWVAVILYDGSNQYYADSVKGRFTISRDNSK<br>NTLYLQMNTLRAEDTAMYYCAKSSSSHVNSRQDKWGQ<br>GTLVTVSS |
| 326 | 5203 | 1507 | FTFSSFSMH |
| 326 | 5204 | 1508 | TTCACCTTCAGTAGTTTTAGCATGCAC |
| 326 | 5205 | 1509 | VILYDGSNQYYADSVKG |
| 326 | 5206 | 1510 | GTGATTTTATATGATGGGAGTAATCAATACTATGCAG<br>ACTCCGTGAAGGGC |
| 326 | 5207 | 1511 | AKSSSSHVNSRQDK |
| 326 | 5208 | 1512 | GCGAAATCATCATCGTCCCATGTTAACTCTCGACAAG<br>ACAAA |
| 326 | 5209 | 1513 | GAAATTGTATTGACACAGTCTCCTTCCACCCTGTCTGC<br>ATCTGTAGGAGACAGAGTCACCATCACTTGCCGGGCC<br>AGTCAGAGTATTAGTAGGTGGTTGGCCTGGTATCAGC<br>AGAAACCAGGGGAAGCCCCTAAACTCCTGATCCACAC<br>GGCGTCTACATTAGAAAGTGGGGTCCCATCAAGGTTC<br>AGCGGCAGTGGCTCTGGGACAGAATTCACTCTCACCA<br>TCAACAGCCTGCAGCCTGATGATCTTGCAACTTATTAC<br>TGCCAACAGTATTATAATTGGTGGACGTTCGGCCAAG<br>GGACCAAGGTGGAGATCAAA |
| 326 | 5210 | 1514 | EIVLTQSPSTLSASVGDRVTITCRASQSISRWLAWYQQKP<br>GEAPKLLIHTASTLESGVPSRFSGSGSGTEFTLTINSLQPD<br>DLATYYCQQYYNWWTFGQGTKVEIK |
| 326 | 5211 | 1515 | RASQSISRWLA |
| 326 | 5212 | 1516 | CGGGCCAGTCAGAGTATTAGTAGGTGGTTGGCC |
| 326 | 5213 | 1517 | TASTLES |

TABLE 6-continued

Informal Sequence Listing

| Antibody No. | Seq. Ref. No. | SEQ ID NO. | Sequence |
|---|---|---|---|
| 326 | 5214 | 1518 | ACGGCGTCTACATTAGAAAGT |
| 326 | 5215 | 1519 | QQYYNWWT |
| 326 | 5216 | 1520 | CAACAGTATTATAATTGGTGGACG |
| 327 | 5217 | 1521 | GAGGTGCAGCTGTTGGAGTCCGGAGCTGAGGTGAAGA AGCCTGGGGCCTCAGTGAAGATCTCCTGCAAGGCCTC TGGTTACATCTTTACCAGTTATGGTGTCAGTTGGGTGC GACAGGCCCCTGGACAAGGGCTTAAGTGGATGGGATG GATCAGCGGTTACAATGGTAACACATACTATGACCAG AAATTCCAGGGCAGAGTCACCATGACCACAGACACAT CCACGAACACAGCCTACATGGAGTTGAGGAGCCTGAC ATCTGACGACACGGCCGTATATTACTGTGCGAGAGAT TCCTTTTCAGAGACTGGGACTGGATTTCCTGACTTCTG GGGCCAGGGCACCCTGGTCACCGTCTCTTCA |
| 327 | 5218 | 1522 | EVQLLESGAEVKKPGASVKISCKASGYIFTSYGVSWVRQ APGQGLKWMGWISGYNGNTYYDQKFQGRVTMTTDTST NTAYMELRSLTSDDTAVYYCARDSFSETGTGFPDFWGQ GTLVTVSS |
| 327 | 5219 | 1523 | YIFTSYGVS |
| 327 | 5220 | 1524 | TACATCTTTACCAGTTATGGTGTCAGT |
| 327 | 5221 | 1525 | WISGYNGNTYYDQKFQG |
| 327 | 5222 | 1526 | TGGATCAGCGGTTACAATGGTAACACATACTATGACC AGAAATTCCAGGGC |
| 327 | 5223 | 1527 | ARDSFSETGTGFPDF |
| 327 | 5224 | 1528 | GCGAGAGATTCCTTTTCAGAGACTGGGACTGGATTTC CTGACTTC |
| 327 | 5225 | 1529 | GAATTGTGTTGACGCAGTCTCCACTCTCCCTGCCCGT CACCCTTGGACAGCCGGCCTCCATCTCCTGCAGGTCTA GTCAAAGCCTCGAATACAGTGATGGAAACACCTACTT GAATTGGTTTCAGCAGAGGCCAGGCCAATCTCCAAGG CGCCTAATTTATAAGGTTTCTAACCGGGACTCTGGGGT CCCCGACAGATTCAGCGGCAGTGGGTCAGGCACTGAT TTCACACTGAAAATCAGCAGGGTGGAGGCTGAGGATG TTGGAGTTTATTACTGCATGCAAGCCACACACCGGCC TCGCACGTTCGGCCAAGGGACCAAAGTGGATATCAAA |
| 327 | 5226 | 1530 | EIVLTQSPLSLPVTLGQPASISCRSSQSLEYSDGNTYLNW FQQRPGQSPRRLIYKVSNRDSGVPDRFSGSGSGTDFTLKI SRVEAEDVGVYYCMQATHRPRTFGQGTKVDIK |
| 327 | 5227 | 1531 | RSSQSLEYSDGNTYLN |
| 327 | 5228 | 1532 | AGGTCTAGTCAAAGCCTCGAATACAGTGATGGAAACA CCTACTTGAAT |
| 327 | 5229 | 1533 | KVSNRDS |
| 327 | 5230 | 1534 | AAGGTTTCTAACCGGGACTCT |
| 327 | 5231 | 1535 | MQATHRPRT |
| 327 | 5232 | 1536 | ATGCAAGCCACACACCGGCCTCGCACG |
| 328 | 5233 | 1537 | CAGGTCCAGCTGGTGCAGTCTGGAGCAGAGGTGAAAA AGCCCGGGGAGTCTCTGAAGATCTCCTGTAAGGGTTT TGGATACAGCTTTAACAGTTACTGGATCGCCTGGGTG CGCCAGATGCCCGGGAAAGGCCTGGAGTGCATGGGC ATCATCTATCCTGGCGACTCTGATACCAGATACAGCC CGTCCTTCCAAGGGCAGGTCACCATCTCAGTCGACAA GTCCATCACTACCGCCTACCTGCAGTGGAGCAGCCTG AAGGTCTCGGACACCGCCATGTATTACTGTGCGAAAA GTAATGTGGGGAATACAGGTTGGAACTACTGGGCCA GGGAACCCTGGTCACCGTCTCCTCA |

TABLE 6-continued

Informal Sequence Listing

| Antibody No. | Seq. Ref. No. | SEQ ID NO. | Sequence |
|---|---|---|---|
| 328 | 5234 | 1538 | QVQLVQSGAEVKKPGESLKISCKGFGYSFNSYWIAWVRQMPGKGLECMGIIYPGDSDTRYSPSFQGQVTISVDKSITTAYLQWSSLKVSDTAMYYCAKSNVGNTGWNYWGQGTLVTVSS |
| 328 | 5235 | 1539 | YSFNSYWIA |
| 328 | 5236 | 1540 | TACAGCTTTAACAGTTACTGGATCGCC |
| 328 | 5237 | 1541 | IIYPGDSDTRYSPSFQG |
| 328 | 5238 | 1542 | ATCATCTATCCTGGCGACTCTGATACCAGATACAGCCCGTCCTTCCAAGGG |
| 328 | 5239 | 1543 | AKSNVGNTGWNY |
| 328 | 5240 | 1544 | GCGAAAAGTAATGTGGGGAATACAGGTTGGAACTAC |
| 328 | 5241 | 1545 | GAAATTGTATTGACACAGTCTCCAGCCACCCTGTCTTTGTCTCCAGGGGAAAGAGCCACCCTCTCCTGCAGGGCCAGTCACAGTGTTGCCACCGACCTAGCCTGGTACCAGCAGAAACCTGGCCAGGCTCCCAGGCTCCTCATCTATGATGCATCCAAGAGGGCCACTGACGTCCCAGCCAGGTTCAGTGGCAGTGGGTCTGGGACAGACTTCACTCTCACCATCAGCAGCCTAGAGCCTGAAGATGTTGCAGTTTATTACTGTCAGGAAGTTAGGAACTGGCCTCCGTGCACTTTTGGCCAGGGGACCAAAGTGGATATCAAA |
| 328 | 5242 | 1546 | EIVLTQSPATLSLSPGERATLSCRASHSVATDLAWYQQKPGQAPRLLIYDASKRATDVPARFSGSGSGTDFTLTISSLEPEDVAVYYCQEVRNWPPCTFGQGTKVDIK |
| 328 | 5243 | 1547 | RASHSVATDLA |
| 328 | 5244 | 1548 | AGGGCCAGTCACAGTGTTGCCACCGACCTAGCC |
| 328 | 5245 | 1549 | DASKRAT |
| 328 | 5246 | 1550 | GATGCATCCAAGAGGGCCACT |
| 328 | 5247 | 1551 | QEVRNWPPCT |
| 328 | 5248 | 1552 | CAGGAAGTTAGGAACTGGCCTCCGTGCACT |
| 329 | 5249 | 1553 | GAGGTGCAGCTGCAGGAGTCCGGCTCTCGACTGGTGAAGCCTTCACAGACCCTGTCCCTCACCTGCTCTGTCTCTGGTGGCTCCCTCAACGCAGGCGGTTACCTGTGGAGCTGGATCCGTCAGCCACCAGGGAAGGGCCTGGAGTGGGTTGGGTACATCTATCCTAGTGGGACTACCTACTACAACCCGTCCCTGCAGAGTCGAATCAGCATTTCACAAGACAGGTCCAGGAACCAGTTCTCCCTGAGCGTAGCGTCTGTGACCGCCGCGGACACGGCCGTCTATTACTGTGCCAGATGTGGGAATGAGTACGGTGAGGTCCATCCTTTTGATATTTGGGGCCAAGGGACCACGGTCACCGTCTCCTCA |
| 329 | 5250 | 1554 | EVQLQESGSRLVKPSQTLSLTCSVSGGSLNAGGYLWSWIRQPPPGKGLEWVGYIYPSGTTYYNPSLQSRISISQDRSRNQFSLSVASVTAADTAVYYCARCGNEYGEVHPFDIWGQGTTVTVSS |
| 329 | 5251 | 1555 | GSLNAGGYLWS |
| 329 | 5252 | 1556 | GGCTCCCTCAACGCAGGCGGTTACCTGTGGAGC |
| 329 | 5253 | 1557 | YIYPSGTTYYNPSLQS |
| 329 | 5254 | 1558 | TACATCTATCCTAGTGGGACTACCTACTACAACCCGTCCCTGCAGAGT |
| 329 | 5255 | 1559 | ARCGNEYGEVHPFDI |
| 329 | 5256 | 1560 | GCCAGATGTGGGAATGAGTACGGTGAGGTCCATCCTTTTGATATT |

TABLE 6-continued

Informal Sequence Listing

| Antibody No. | Seq. Ref. No. | SEQ ID NO. | Sequence |
|---|---|---|---|
| 329 | 5257 | 1561 | GAAATTGTATTGACACAGTCTCCAGGCACCCTGTCTTT GTCTCCAGGGGAAAGAGCCACCCTCTCCTGCCGGGGC AGTCCTATTGTTGGCAACAACTACTTAGCCTGGTACCA GCAGAAGCCTGGCCAGGCTCCCAGGCTCCTCATCTAT GCTGCATCCATCAGGGCCACTGGCATCCCAGACAGGT TCAGTGGCAGTGGGTCTGGGACAGACTTCACTCTCAC CATCAGCAGACTAGAGCCTGAAGATTTTGCAGTCTAT TACTGTCAGCAATATGGCAGCTCACCGTGGACGTTCG GCCAAGGGACCAAAGTGGATATCAAA |
| 329 | 5258 | 1562 | EIVLTQSPGTLSLSPGERATLSCRGSPIVGNNYLAWYQQ KPGQAPRLLIYAASIRATGIPDRFSGSGSGTDFTLTISRLE PEDFAVYYCQQYGSSPWTFGQGTKVDIK |
| 329 | 5259 | 1563 | RGSPIVGNNYLA |
| 329 | 5260 | 1564 | CGGGGCAGTCCTATTGTTGGCAACAACTACTTAGCC |
| 329 | 5261 | 1565 | AASIRAT |
| 329 | 5262 | 1566 | GCTGCATCCATCAGGGCCACT |
| 329 | 5263 | 1567 | QQYGSSPWT |
| 329 | 5264 | 1568 | CAGCAATATGGCAGCTCACCGTGGACG |
| 330 | 5265 | 1569 | CAGGTGCAGCTGGTGCAGTCTGGAGCTGAGGTGAAGA AGCCTGGGGCCTCAGTGAAGGTCTCCTGCAAGGCTTC TGGTTACATCTTTACCAGTTATGGTGTCAGCTGGGTGC GACAGGCCCCTGGACAAGGGCTTAAGTGGATGGGATG GATCAGCGGTTACAATGGTAACACAAACTATGACCAG AAACTCCAGGGCAGAGTCACCATGACCACAGACACAT CCACGAGCACAGCCTACATGGAGCTGAGGAGCCTGAC ATCTGACGACACGGCCGTTTATTACTGTGCGAGAGAT TCATTTTCAGAGACTGGGACTGGGTTTCCTGACTTCTG GGGCCAGGGAACCCTGGTCACCGTCTCCTCA |
| 330 | 5266 | 1570 | QVQLVQSGAEVKKPGASVKVSCKASGYIFTSYGVSWVR QAPGQGLKWMGWISGYNGNTNYDQKLQGRVTMTTDT STSTAYMELRSLTSDDTAVYYCARDSFSETGTGFPDFWG QGTLVTVSS |
| 330 | 5267 | 1571 | YIFTSYGVS |
| 330 | 5268 | 1572 | TACATCTTTACCAGTTATGGTGTCAGC |
| 330 | 5269 | 1573 | WISGYNGNTNYDQKLQG |
| 330 | 5270 | 1574 | TGGATCAGCGGTTACAATGGTAACACAAACTATGACC AGAAACTCCAGGGC |
| 330 | 5271 | 1575 | ARDSFSETGTGFPDF |
| 330 | 5272 | 1576 | GCGAGAGATTCATTTTCAGAGACTGGGACTGGGTTTC CTGACTTC |
| 330 | 5273 | 1577 | GACATCCAGATGACCCAGTCTCCACTCTCCCTGCCCGT CACCCTTGGACAGCCGGCTCCATCTCCTGCAGGTCTA GTCAAAGCCTCGAATACAGTGATGGAAACACCTACTT GAATTGGTTTCAGCAGAGGCCAGGCCAATCTCCAAGG CGCCTAATTTATAAGGTTTCTAACCGGGACTCTGGGGT CCCAGACAGATTCAGCGGCAGTGGGTCAGGCACTGAT TTCACACTGAAAATCAGCAGGGTGGAGGCTGAGGATG TTGGAGTTTATTACTGCATGCAAGCCACACACCGGCC TCGCACGTTCGGCCAAGGGACCAAGCTGGAGATCAAA |
| 330 | 5274 | 1578 | DIQMTQSPLSLPVTLGQPASISCRSSQSLEYSDGNTYLNW FQQRPGQSPRRLIYKVSNRDSGVPDRFSGSGSGTDFTLKI SRVEAEDVGVYYCMQATHRPRTFGQGTKLEIK |
| 330 | 5275 | 1579 | RSSQSLEYSDGNTYLN |
| 330 | 5276 | 1580 | AGGTCTAGTCAAAGCCTCGAATACAGTGATGGAAACA CCTACTTGAAT |

TABLE 6-continued

Informal Sequence Listing

| Antibody No. | Seq. Ref. No. | SEQ ID NO. | Sequence |
|---|---|---|---|
| 330 | 5277 | 1581 | KVSNRDS |
| 330 | 5278 | 1582 | AAGGTTTCTAACCGGGACTCT |
| 330 | 5279 | 1583 | MQATHRPRT |
| 330 | 5280 | 1584 | ATGCAAGCCACACACCGGCCTCGCACG |
| 331 | 5281 | 1585 | GAGGTGCAGCTGGTGGAGTCTGGGGGAGGCGTGGTCC AGCCTGGGAGGTCCCTGAGACTCTCCTGTGCAGCGTC TGGATTCACCTTCAGTAGTTTTTCTATGCACTGGGTCC GCCAGGCTCCAGGCAAGGGGCTGGAGTGGGTGGCACT TATATCATCTGACGAGAGGAATTCATACTACGCAGAC TCCGTGAAGGGCCGATTCACCATCTCCAGAGACAATT CCAAGAACACGCTGTATCTGCAAATAAGCAGGCTGAA AGTCGAGGACACGGCTGTGTATTATTGTGCGAGAGAG GCATACGAAGAGTGGGAGCTAACGATGGGGAACCTT GACCACTGGGGCCAGGGAACCCTGGTCACCGTCTCCT CA |
| 331 | 5282 | 1586 | EVQLVESGGGVVQPGRSLRLSCAASGFTFSSFSMHWVR QAPGKGLEWVALISSDERNSYYADSVKGRFTISRDNSKN TLYLQISRLKVEDTAVYYCAREAYEEWELTMGNLDHW GQGTLVTVSS |
| 331 | 5283 | 1587 | FTFSSFSMH |
| 331 | 5284 | 1588 | TTCACCTTCAGTAGTTTTTCTATGCAC |
| 331 | 5285 | 1589 | LISSDERNSYYADSVKG |
| 331 | 5286 | 1590 | CTTATATCATCTGACGAGAGGAATTCATACTACGCAG ACTCCGTGAAGGGC |
| 331 | 5287 | 1591 | AREAYEEWELTMGNLDH |
| 331 | 5288 | 1592 | GCGAGAGAGGCATACGAAGAGTGGGAGCTAACGATG GGGAACCTTGACCAC |
| 331 | 5289 | 1593 | GACATCCAGTTGACCCAGTCTCCATCCTCCCTGTCTGC ATCTGTAGGAGACAGAGTCACCATCACTTGCCGGGCA AGTCAGGGCATTGGAAATGATTTAGGCTGGTATCAGC AGAAACCAGGGAAAGCCCCTAAGCGCCTGATCTATAG TACATACAGCTTGCAAAGTGGGGTCCCATCAAGGTTC AGCGGCAGTGGATCTGGGACAGAATTCACTCTCACAA TCAGCAGCCTGCAGCCTGAAGATTTTGCAACTTATTAC TGTCTACAGCATAATCGTTACCCCTTCACTTTCGGCCC TGGGACCAAGCTGGAGATCAAA |
| 331 | 5290 | 1594 | DIQLTQSPSSLSASVGDRVTITCRASQGIGNDLGWYQQK PGKAPKRLIYSTYSLQSGVPSRFSGSGSGTEFTLTISSLQP EDFATYYCLQHNRYPFTFGPGTKLEIK |
| 331 | 5291 | 1595 | RASQGIGNDLG |
| 331 | 5292 | 1596 | CGGGCAAGTCAGGGCATTGGAAATGATTTAGGC |
| 331 | 5293 | 1597 | STYSLQS |
| 331 | 5294 | 1598 | AGTACATACAGCTTGCAAAGT |
| 331 | 5295 | 1599 | LQHNRYPFT |
| 331 | 5296 | 1600 | CTACAGCATAATCGTTACCCCTTCACT |
| 332 | 5297 | 1601 | CAGGTGCAGCTGCAGGAGTCGGGCCCAGGACTGGTGA AGCCTTCGGAGACCCTGTCCCTCACCTGCACTGTCTCT GGTGCCTCCGTCACCACTAATACTTACTACTGGACCTG GATCCGGCAGCCCCCAGGGAAGGAACTGGAGTGGATT GGATATATCCATCACACTGGGAACACCCACTACAACC CCTCCCTCGAGAGTCGACTCACCATGTCACTAGACAC GTCCAGGAACCAGTTCTCTCTGAACCTTAGGTCTGCCA CCACTGCGGACACGGCCGTTTATTACTGTGCGAGAGG CGAACATTTTGCGTACTGGTGGGGAAACTGGGGCCAG GGAGCCCTGGTCACCGTCTCCTCA |

TABLE 6-continued

Informal Sequence Listing

| Antibody No. | Seq. Ref. No. | SEQ ID NO. | Sequence |
|---|---|---|---|
| 332 | 5298 | 1602 | QVQLQESGPGLVKPSETLSLTCTVSGASVTTNTYYWTWI RQPPGKELEWIGYIHHTGNTHYNPSLESRLTMSLDTSRN QFSLNLRSATTADTAVYYCARGEHFAYWWGNWGQGA LVTVSS |
| 332 | 5299 | 1603 | ASVTTNTYYWT |
| 332 | 5300 | 1604 | GCCTCCGTCACCACTAATACTTACTACTGGACC |
| 332 | 5301 | 1605 | YIHHTGNTHYNPSLES |
| 332 | 5302 | 1606 | TATATCCATCACACTGGGAACACCCACTACAACCCCT CCCTCGAGAGT |
| 332 | 5303 | 1607 | ARGEHFAYWWGN |
| 332 | 5304 | 1608 | GCGAGAGGCGAACATTTTGCGTACTGGTGGGGAAAC |
| 332 | 5305 | 1609 | GACATCCGGGTGACCCAGTCTCCATCTTCCGTGTCTGC ATCTGTAGGAGACAGAGTCACCATCACTTGTCGGGCG AGTCAGGGTATTGCCAGATGGTTAGCCTGGTATCAGC AGAAACCAGGGAAAGCCCCTAAACTCCTGATCTATGC TGCATCCAGTTTGCAAGGTGGGGTCCCATCAAGGTTC AGCGGCAGTGGATATGGGACAGATTTCACTCTCACCA TCAGCAGCCTGCAGCCTGAAGATTTTGCAACTTACTA CTGTCAACAGGCTAACAGTTTTCCTCGAACGTTCGGCC AAGGGACCAAGGTGGAGATCAAA |
| 332 | 5306 | 1610 | DIRVTQSPSSVSASVGDRVTITCRASQGIARWLAWYQQK PGKAPKLLIYAASSLQGGVPSRFSGSGYGTDFTLTISSLQ PEDFATYYCQQANSFPRTFGQGTKVEIK |
| 332 | 5307 | 1611 | RASQGIARWLA |
| 332 | 5308 | 1612 | CGGGCGAGTCAGGGTATTGCCAGATGGTTAGCC |
| 332 | 5309 | 1613 | AASSLQG |
| 332 | 5310 | 1614 | GCTGCATCCAGTTTGCAAGGT |
| 332 | 5311 | 1615 | QQANSFPRT |
| 332 | 5312 | 1616 | CAACAGGCTAACAGTTTTCCTCGAACG |
| 333 | 5313 | 1617 | CAGGTCCAGCTTGTACAGTCTGGGCCTGAGGTGAAGA AGCCTGGGGCCTCAGTGAAGGTCTCCTGCGAGGCTTC TGGATACACCTTCACCGACTTCTTTGTGCACTGGGTGC GACAGGCCCCTGGTGAGGGGCTTGTGTGGTTGGGATG GGTCAACCCTCTCAGTGGCGCCACAAAGTATGCACAG AACTTTCAGGGCAGGGTCACCATGACCAGTGACACGT CCATCACCACAGCCTACATGGCACTGAGCAGCCTGAG ACATGACGACACGGCCGTCTATTACTGTACGAGCCAG ACTTCACCTTATACCCCGGGCGCTATGGGCGTTTGGG GCCAAGGGACCACGGTCACCGTCTCCTCA |
| 333 | 5314 | 1618 | QVQLVQSGPEVKKPGASVKVSCEASGYTFTDFFVHWVR QAPGEGLVWLGWVNPLSGATKYAQNFQGRVTMTSDTS ITTAYMALSSLRHDDTAVYYCTSQTSPYTPGAMGVWGQ GTTVTVSS |
| 333 | 5315 | 1619 | YTFTDFFVH |
| 333 | 5316 | 1620 | TACACCTTCACCGACTTCTTTGTGCAC |
| 333 | 5317 | 1621 | WVNPLSGATKYAQNFQG |
| 333 | 5318 | 1622 | TGGGTCAACCCTCTCAGTGGCGCCACAAAGTATGCAC AGAACTTTCAGGGC |
| 333 | 5319 | 1623 | TSQTSPYTPGAMGV |
| 333 | 5320 | 1624 | ACGAGCCAGACTTCACCTTATACCCCGGGCGCTATGG GCGTT |

TABLE 6-continued

Informal Sequence Listing

| Antibody No. | Seq. Ref. No. | SEQ ID NO. | Sequence |
|---|---|---|---|
| 333 | 5321 | 1625 | GACATCCGGGTGACCCAGTCTCCAGCCTCCCTGTCTGC<br>ATTTGTTGGAGACAGAGTCACCATCACTTGCCGGGCA<br>AGTCCGGCCATTAGCGGCTATTTAAGTTGGTATCAGC<br>AGAAGGCAGGCAAAGCCCCTAAGATCCTGATCTATGA<br>TGCATCTAATTTGTATAGTGGGGCCCCATCACGGTTCA<br>GTGGCAGTAGATCTGGGACAGATTTCACTCTCACCAT<br>CACCAGTCTGCAACCTGAAGATTTTGCAACTTACTACT<br>GTCAACAGACTTACAATGGCCTAATCGCTTTCGGCCCT<br>GGGACCAAGGTGGAAATCAAA |
| 333 | 5322 | 1626 | DIRVTQSPASLSAFVGDRVTITCRASPAISGYLSWYQQKA<br>GKAPKILIYDASNLYSGAPSRFSGSRSGTDFTLTITSLQPE<br>DFATYYCQQTYNGLIAFGPGTKVEIK |
| 333 | 5323 | 1627 | RASPAISGYLS |
| 333 | 5324 | 1628 | CGGGCAAGTCCGGCCATTAGCGGCTATTTAAGT |
| 333 | 5325 | 1629 | DASNLYS |
| 333 | 5326 | 1630 | GATGCATCTAATTTGTATAGT |
| 333 | 5327 | 1631 | QQTYNGLIA |
| 333 | 5328 | 1632 | CAACAGACTTACAATGGCCTAATCGCT |
| 334 | 5329 | 1633 | GAGGTGCAGCTGTTGGAGTCTGGGGGAGGCGTGGTCC<br>AGCCTGGGAAGTCCCTGAGACTCTCCTGTGCAGCCTC<br>TGGATTCACCTTCAATACCTATGCTATACACTGGGTCC<br>GCCAGGCTCCAGGCAAGGGCCTGGAGTGGGTGGCAG<br>CTATATCATATGATGGAAGCAATGAATACTACTCAAA<br>CTCCGTGAAGGGCCGATTCACCATCTCCAGAGACAAT<br>TCCAAGTACACGCTGGAGCTGCAAATGAACAGCCTGA<br>GACCTGAGGACACGGCTGTGTATTACTGTGCGAGAGG<br>CGCCTCCTACTACTATGTGAGTAGTGACCTTGGCTACT<br>GGGGCCAGGGAACCCTGGTCACCGTCTCCTCA |
| 334 | 5330 | 1634 | EVQLLESGGGVVQPGKSLRLSCAASGFTFNTYAIHWVR<br>QAPGKGLEWVAAISYDGSNEYYSNSVKGRFTISRDNSK<br>YTLELQMNSLRPEDTAVYYCARGASYYYVSSDLGYWG<br>QGTLVTVSS |
| 334 | 5331 | 1635 | FTFNTYAIH |
| 334 | 5332 | 1636 | TTCACCTTCAATACCTATGCTATACAC |
| 334 | 5333 | 1637 | AISYDGSNEYYSNSVKG |
| 334 | 5334 | 1638 | GCTATATCATATGATGGAAGCAATGAATACTACTCAA<br>ACTCCGTGAAGGGC |
| 334 | 5335 | 1639 | ARGASYYYVSSDLGY |
| 334 | 5336 | 1640 | GCGAGAGGCGCCTCCTACTACTATGTGAGTAGTGACC<br>TTGGCTAC |
| 334 | 5337 | 1641 | CAGTCTGTCGTGACGCAGCCGCCCTCAGTGTCTGGGG<br>CCCCAGGGCAGAGGGTCACCATCTCCTGCACTGGGAG<br>CAGCTCCAACATCGGGTCAGGTTATGATGTGCACTGG<br>TACCAGCAGCTTCCAGGAACAGCCCCCAAAGTCGTCA<br>TCTATGGTAACATCAATCGGCCCTCAGGGGTCCCTGA<br>GCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCCTGAGTGCCTCTT<br>GGGTGTTCGGCGGAGGGACCAAGCTGACCGTCCTA |
| 334 | 5338 | 1642 | QSVVTQPPSVSGAPGQRVTISCTGSSSNIGSGYDVHWYQ<br>QLPGTAPKVVIYGNINRPSGVPERFSGSKSGTSASLAITG<br>LQAEDEADYYCQSYDSLSASWVFGGGTKLTVL |
| 334 | 5339 | 1643 | TGSSSNIGSGYDVH |
| 334 | 5340 | 1644 | ACTGGGAGCAGCTCCAACATCGGGTCAGGTTATGATG<br>TGCAC |

TABLE 6-continued

Informal Sequence Listing

| Antibody No. | Seq. Ref. No. | SEQ ID NO. | Sequence |
|---|---|---|---|
| 334 | 5341 | 1645 | GNINRPS |
| 334 | 5342 | 1646 | GGTAACATCAATCGGCCCTCA |
| 334 | 5343 | 1647 | QSYDSLSASWV |
| 334 | 5344 | 1648 | CAGTCCTATGACAGCCTGAGTGCCTCTTGGGTG |
| 335 | 5345 | 1649 | CAGGTCCAGCTTGTGCAGTCTGGGGCTGAGGTGAAGA<br>AGCCTGGGTCCTCGGTGAAGGTCTCCTGCAAGGCCTC<br>TGGAGGCACCTTCAGCGGCCACGCTATCAACTGGGTG<br>CGACAGGCCCCTGGACAAGGGCTCGAATGGATGGGA<br>GGGATCATCCATATATTTGGGACAGTAAACTACGCTC<br>CGAAGTTCCAGGGCAGAGTCACGATCACCGCGGACGC<br>ATCCACGGGCACAGTTTACATGGAGTTGAGCAGCCTG<br>ATATCTGAGGACACGGCCGTATATTATTGTGCGAGAG<br>ATGCTTACGAAGTGTGGACTGGTTCTTATCTCCCCCCT<br>TTTGACGACTGGGGCCAGGGAACCCTGGTCACTGTCT<br>CCTCA |
| 335 | 5346 | 1650 | QVQLVQSGAEVKKPGSSVKVSCKASGGTFSGHAINWVR<br>QAPGQGLEWMGGIIHIFGTVNYAPKFQGRVTITADASTG<br>TVYMELSSLISEDTAVYYCARDAYEVWTGSYLPPFDDW<br>GQGTLVTVSS |
| 335 | 5347 | 1651 | GTFSGHAIN |
| 335 | 5348 | 1652 | GGCACCTTCAGCGGCCACGCTATCAAC |
| 335 | 5349 | 1653 | GIIHIFGTVNYAPKFQG |
| 335 | 5350 | 1654 | GGGATCATCCATATATTTGGGACAGTAAACTACGCTC<br>CGAAGTTCCAGGGC |
| 335 | 5351 | 1655 | ARDAYEVWTGSYLPPFDD |
| 335 | 5352 | 1656 | GCGAGAGATGCTTACGAAGTGTGGACTGGTTCTTATC<br>TCCCCCCTTTTGACGAC |
| 335 | 5353 | 1657 | GATATTGTGATGACGCAGTCTCCAGGCACCCTGTCTTT<br>GTCTCCCGGGGACAGAGTCACCCTCTCCTGCAGGGCC<br>AGTCAGACTGTTACAAGCAGCTACTTAGCCTGGTACC<br>AGCAGAAACCTGGCCAGGCTCCCAGGCTCCTCATCTA<br>TGGTGCATTCACCAGGGCCACTGGCATCCCAGACAGG<br>TTCAGTGGCAGTGGGTCTGGGACAGACTTCACTCTCA<br>GCATCAGCAGACTGGAGCCTGAAGATTTTGCAGTATA<br>TTATTGTCAGCAGTATGGTAGCTCATTCCTCACTTTCG<br>GCGGAGGGACCAAAGTGGATATCAAA |
| 335 | 5354 | 1658 | DIVMTQSPGTLSLSPGDRVTLSCRASQTVTSSYLAWYQQ<br>KPGQAPRLLIYGAFTRATGIPDRFSGSGSGTDFTLSISRLE<br>PEDFAVYYCQQYGSSFLTFGGGTKVDIK |
| 335 | 5355 | 1659 | RASQTVTSSYLA |
| 335 | 5356 | 1660 | AGGGCCAGTCAGACTGTTACAAGCAGCTACTTAGCC |
| 335 | 5357 | 1661 | GAFTRAT |
| 335 | 5358 | 1662 | GGTGCATTCACCAGGGCCACT |
| 335 | 5359 | 1663 | QQYGSSFLT |
| 335 | 5360 | 1664 | CAGCAGTATGGTAGCTCATTCCTCACT |
| 336 | 5361 | 1665 | GAGGTGCAGCTGGTGGAATCTGGGGGAGGCCTGGTCA<br>GGCCTGGGGGGTCCCTGAGACTCTCCTGTGCAGCCTC<br>TGGATTCAGTCTCAGTAGTTACGGCATGAGTTGGGTC<br>CGCCAGGCTCCAGGGAAGGGTCTGGAGTGGGTCTCAT<br>CCATTACTGCCGGCAGTAGTTACATAAATTACGCTGA<br>CTCAGTGAAGGGCCGGTTCACCATCTCCAGAGACAAC<br>GCCAAGAGTTCACTGTTCCTGCAAATGACCAGCCTGA<br>GAGTCGAGGACACGGCTGTTTATTTCTGTGTGAGAGA<br>GGCGTATGCCAGCTCGTCGGCCCTTTACTGGTTCGACC<br>CCTGGGGCCAGGGAACCCTGGTCACCGTCTCCTCA |

TABLE 6-continued

Informal Sequence Listing

| Antibody No. | Seq. Ref. No. | SEQ ID NO. | Sequence |
|---|---|---|---|
| 336 | 5362 | 1666 | EVQLVESGGGLVRPGGSLRLSCAASGFSLSSYGMSWVRQAPGKGLEWVSSITAGSSYINYADSVKGRFTISRDNAKSSLFLQMTSLRVEDTAVYFCVREAYASSSALYWFDPWGQGTLVTVSS |
| 336 | 5363 | 1667 | FSLSSYGMS |
| 336 | 5364 | 1668 | TTCAGTCTCAGTAGTTACGGCATGAGT |
| 336 | 5365 | 1669 | SITAGSSYINYADSVKG |
| 336 | 5366 | 1670 | TCCATTACTGCCGGCAGTAGTTACATAAATTACGCTGACTCAGTGAAGGGC |
| 336 | 5367 | 1671 | VREAYASSSALYWFDP |
| 336 | 5368 | 1672 | GTGAGAGAGGCGTATGCCAGCTCGTCGGCCCTTTACTGGTTCGACCCC |
| 336 | 5369 | 1673 | CAGTCTGTCCTGACGCAGCCGCCCTCAGTCTCTGGGGCCCCAGGGCAGAGGGTCACCATCTCCTGCACTGGGAGCAGCTCCAATCTCGGGGCGGGTTATGTTGTTCACTGGTACCAGCAACTTCCAGGAACATCCCCCAAACTCCTCATCTATGGTAACACCGATCGGCCCTCAGGGGTCCCCGACCGATTCTCTGGCTCCAAGTCTGGCACCTCAGCCTCCCTGGCCATCAGTGGGCTCCAGGCTGAGGATGAGGCTGATTATTACTGCCAGTCCTATGACAGTAGCCTGAGTGGCTGGGTGTTCGGCGGAGGGACCAAGCTGACCGTCCTA |
| 336 | 5370 | 1674 | QSVLTQPPSVSGAPGQRVTISCTGSSSNLGAGYVVHWYQQLPGTSPKLLIYGNTDRPSGVPDRFSGSKSGTSASLAISGLQAEDEADYYCQSYDSSLSGWVFGGGTKLTVL |
| 336 | 5371 | 1675 | TGSSSNLGAGYVVH |
| 336 | 5372 | 1676 | ACTGGGAGCAGCTCCAATCTCGGGGCGGGTTATGTTGTTCAC |
| 336 | 5373 | 1677 | GNTDRPS |
| 336 | 5374 | 1678 | GGTAACACCGATCGGCCCTCA |
| 336 | 5375 | 1679 | QSYDSSLSGWV |
| 336 | 5376 | 1680 | CAGTCCTATGACAGTAGCCTGAGTGGCTGGGTG |
| 337 | 5377 | 1681 | GAGGTGCAGCTGGTGGAGTCTGGGGGAGGCTTAGTACAGCCTGGGGGGTCCCTGCGACTCTCCTGTGCAGCCTCTGGATTCAGCTTCAATACCTATAGCATGAACTGGGTCCGCCAGGCTCCAGGGAAGGGATTGGAGTGGCTTTCATTCATTAGTAGTAGTAGTCATACCCTATACTACGCAGACTCTGTGAAGGGCCGATTCACCGTCTTCAGAGACAATGCCAAGCACTCGCTCTTTCTGCAAATGAACGGCCTGAGAGACGAGGACACGGCTGTTTATTTCTGTGCGAGATCCCTTGGTTCGGGGAATTATGATAACGAAGATCAGACATTTTACTACTACACGGTATGGACGTCTGGGGCCAAGGGACCACGGTCACCGTCTCCTCA |
| 337 | 5378 | 1682 | EVQLVESGGGLVQPGGSLRLSCAASGFSFNTYSMNWVRQAPGKGLEWLSFISSSSHTLYYADSVKGRFTVFRDNAKHSLFLQMNGLRDEDTAVYFCARSLGSGNYDNEDQTFYYYGMDVWGQGTTVTVSS |
| 337 | 5379 | 1683 | FSFNTYSMN |
| 337 | 5380 | 1684 | TTCAGCTTCAATACCTATAGCATGAAC |
| 337 | 5381 | 1685 | FISSSSHTLYYADSVKG |
| 337 | 5382 | 1686 | TTCATTAGTAGTAGTAGTCATACCCTATACTACGCAGACTCTGTGAAGGGC |
| 337 | 5383 | 1687 | ARSLGSGNYDNEDQTFYYYGMDV |

TABLE 6-continued

Informal Sequence Listing

| Antibody No. | Seq. Ref. No. | SEQ ID NO. | Sequence |
|---|---|---|---|
| 337 | 5384 | 1688 | GCGAGATCCCTTGGTTCGGGGAATTATGATAACGAAG ATCAGACATTTTACTACTACGGTATGGACGTC |
| 337 | 5385 | 1689 | GAAACGACACTCACGCAGTCTCCACTCTCCCTGCCCG TCACCCCTGGAGAGCCGGCCTCCATATCCTGCCGGTCT AGTCAGAGCCTCCTGTTTCATAGTAATGGACACAATT ATTTGGATTGGTACCTGCAGAAGCCAGGGCAGTCTCC ACAACTCCTGATCCATTTGGGTTCTAATCGGGCCTCCG GAGTCCCTGACAGGTTCAGTGGCAGTGGATCAGGCAC AGATTTTACACTGAAAATCAGCAGAGTGGAGCCTGAG GATGTTGGGGTTTATTACTGTATGCAAGCTCTACAAAC TCCGTACACTTTTGGCCAGGGGACCAAGGTGGAGATC AAA |
| 337 | 5386 | 1690 | ETTLTQSPLSLPVTPGEPASISCRSSQSLLFHSNGHNYLD WYLQKPGQSPQLLIHLGSNRASGVPDRFSGSGSGTDFTL KISRVEPEDVGVYYCMQALQTPYTFGQGTKVEIK |
| 337 | 5387 | 1691 | RSSQSLLFHSNGHNYLD |
| 337 | 5388 | 1692 | CGGTCTAGTCAGAGCCTCCTGTTTCATAGTAATGGAC ACAATTATTTGGAT |
| 337 | 5389 | 1693 | LGSNRAS |
| 337 | 5390 | 1694 | TTGGGTTCTAATCGGGCCTCC |
| 337 | 5391 | 1695 | MQALQTPYT |
| 337 | 5392 | 1696 | ATGCAAGCTCTACAAACTCCGTACACT |
| 338 | 5393 | 1697 | CAGGTGCAGCTGCAGGAGTCGGGCCCAGGACGGGTG AAGCCTTCACAGACCCTGTCCCTCACCTGCACTGTCTC TGGTGTCTCCGTCACCATTAATGATTACTACTGGACTT GGCTCCGCCAGTCCCCAGGGAAAGGCCTGGAGTGGAT TGGAAACATCTATAACAGTGGGAGCACCTACCAGAAC CCGTCCCTCCAGAGTCGAGTTACCATGTCAGTGGACA CGGCCAAGAACCACTTCTCCCTGAAGCTGACCTCTGT CACTGCCGCAGATACGGCCGTCTATTACTGTGCCAGA GATTTAGGCACTGCCAACAACTACTACTTCGGTATGG ACGTCTGGGGCCTAGGGACCACGGTCACCGTCTCCTC A |
| 338 | 5394 | 1698 | QVQLQESGPGRVKPSQTLSLTCTVSGVSVTINDYYWTW LRQSPGKGLEWIGNIYNSGSTYQNPSLQSRVTMSVDTAK NHFSLKLTSVTAADTAVYYCARDLGTANNYYFGMDVW GLGTTVTVSS |
| 338 | 5395 | 1699 | VSVTINDYYWT |
| 338 | 5396 | 1700 | GTCTCCGTCACCATTAATGATTACTACTGGACT |
| 338 | 5397 | 1701 | NIYNSGSTYQNPSLQS |
| 338 | 5398 | 1702 | AACATCTATAACAGTGGGAGCACCTACCAGAACCCGT CCCTCCAGAGT |
| 338 | 5399 | 1703 | ARDLGTANNYYFGMDV |
| 338 | 5400 | 1704 | GCCAGAGATTTAGGCACTGCCAACAACTACTACTTCG GTATGGACGTC |
| 338 | 5401 | 1705 | GATATTGTGCTGACGCAGTCTCCAGCCACCCTGTCTTT GTCTCCAGGGGAAAGAGCCACTCTCTCCTGCAGGGCC AGTCAGAGTGTTAGCACCTACTTAGCCTGGTACCAAC AGAAACCTGGCCAGGCTCCCAGGCTCCTCATCTATAA TGGATCCAACAGGGTCACTGGCACCCCAGCCAGGTTC AGTGGCAGTGGGTCTGGGACAGACTTCACTCTCACCA TCAGCAGCGTAGAGCCTGAAGATTTTGCAGTTTATTA CTGTCAGCAGCGTAGCAACTGGCCTCCGTACACTTTTG GCCAGGGGACCAAGGTGGAGATCAAA |
| 338 | 5402 | 1706 | DIVLTQSPATLSLSPGERATLSCRASQSVSTYLAWYQQK PGQAPRLLIYNGSNRVTGTPARFSGSGSGTDFTLTISSVEP EDFAVYYCQQRSNWPPYTFGQGTKVEIK |

TABLE 6-continued

Informal Sequence Listing

| Antibody No. | Seq. Ref. No. | SEQ ID NO. | Sequence |
|---|---|---|---|
| 338 | 5403 | 1707 | RASQSVSTYLA |
| 338 | 5404 | 1708 | AGGGCCAGTCAGAGTGTTAGCACCTACTTAGCC |
| 338 | 5405 | 1709 | NGSNRVT |
| 338 | 5406 | 1710 | AATGGATCCAACAGGGTCACT |
| 338 | 5407 | 1711 | QQRSNWPPYT |
| 338 | 5408 | 1712 | CAGCAGCGTAGCAACTGGCCTCCGTACACT |
| 339 | 5409 | 1713 | GAGGTGCAGCTGGTGGAGTCGGGCCCTGGACTGGTGAAGCCTTCAGAGACCCTGTCCCTCAGTTGCATTGTCTCTGGTGACTCCATCACCAGTAATGATTACTACTGGAGTTGGATCCGCCAGTCCCCAGGGAAGGGCCTGGAGTGGATTGGGTACATCTATCACAGCGGGGCCACCTTCTACACTCCGTCCCTACGGAGTCGAGTGACCATATCGACAGACAGGTCCAAGAACCAGTTCTCCCTGAGACTGTCGTCTGTGACCGCCGCAGACACGGCCGTATATTATTGTGCCAGTGGACCTGTGGGGATGGCTACAAGCAACTGGTTCGACCCCTGGGGCCAGGGAACCCTGGTCACCGTCTCTTCA |
| 339 | 5410 | 1714 | EVQLVESGPGLVKPSETLSLSCIVSGDSITSNDYYWSWIRQSPGKGLEWIGYIYHSGATFYTPSLRSRVTISTDRSKNQFSLRLSSVTAADTAVYYCASGPVGMATSNWFDPWGQGTLVTVSS |
| 339 | 5411 | 1715 | DSITSNDYYWS |
| 339 | 5412 | 1716 | GACTCCATCACCAGTAATGATTACTACTGGAGT |
| 339 | 5413 | 1717 | YIYHSGATFYTPSLRS |
| 339 | 5414 | 1718 | TACATCTATCACAGCGGGGCCACCTTCTACACTCCGTCCCTACGGAGT |
| 339 | 5415 | 1719 | ASGPVGMATSNWFDP |
| 339 | 5416 | 1720 | GCCAGTGGACCTGTGGGGATGGCTACAAGCAACTGGTTCGACCCC |
| 339 | 5417 | 1721 | CAGCCTGTGCTGACTCAGCCACCCTCAGTGTCAGTCGCCCCGGGAAAGACGGCCACTCTTACGTGTGGGGGAGACATCATTAGAACTAACAGTGTGAACTGGTACCAGCAGAAGCCAGGCCAGGCCCCTGTATTGATCATATATTATGATAGCGACCGGCCCTCAGGGATCCCTGGGCGATTCTCTGCCTCCAACTCTGGGAGCGCGGCCACCCTGACCATCAGCAGGGTCGAAGCCGGGGATGAGGCCGACTATTACTGTCAGGTGTGGGACAGCAGTACTGATTATCACGTGGTTTTCGGCGGAGGGACCAAGCTCACCGTCCTA |
| 339 | 5418 | 1722 | QPVLTQPPSVSVAPGKTATLTCGGDIIRTNSVNWYQQKPGQAPVLIIYYDSDRPSGIPGRFSASNSGSAATLTISRVEAGDEADYYCQVWDSSTDYHVVFGGGTKLTVL |
| 339 | 5419 | 1723 | GGDIIRTNSVN |
| 339 | 5420 | 1724 | GGGGGAGACATCATTAGAACTAACAGTGTGAAC |
| 339 | 5421 | 1725 | YDSDRPS |
| 339 | 5422 | 1726 | TATGATAGCGACCGGCCCTCA |
| 339 | 5423 | 1727 | QVWDSSTDYHVV |
| 339 | 5424 | 1728 | CAGGTGTGGGACAGCAGTACTGATTATCACGTGGTT |
| 340 | 5425 | 1729 | CAGGTCCAGCTGGTACAGTCTGGGGCTGAGGTGAAGAAGCCTGGGGCCTCAGTGAAGGTTTCCTGCAAGGCATCTGGATACATCTTCACCGGTTATTTTATACACTGGGTGCGACAGGCCCCCGGACAAGGGCTTGAGTGGATGGGAGTAATCAATCCCAGAGGTGGAAGCACAAGCTACGCACAAAAGTTCCAGGGCAGAGTCGCTGTGTCCAGGGACACGTCCACGACTACAGTCTACATGGAGCTGAACAGCCTGA |

TABLE 6-continued

Informal Sequence Listing

| Antibody No. | Seq. Ref. No. | SEQ ID NO. | Sequence |
|---|---|---|---|
|  |  |  | GATCTGAGGACACGGCCGTATATTACTGTGCGAGAGC CCCGAGCCACGATGAGTGGGTCGCAATTTCCCGAAAT AACGATGTTGTGGGGTTCGACGCCTGGGGCCAGGGAA CCCTGGTCACCGTCTCCTCA |
| 340 | 5426 | 1730 | QVQLVQSGAEVKKPGASVKVSCKASGYIFTGYFIHWVR QAPGQGLEWMGVINPRGGSTSYAQKFQGRVAVSRDTST TTVYMELNSLRSEDTAVYYCARAPSHDEWVAISRNNDV VGFDAWGQGTLVTVSS |
| 340 | 5427 | 1731 | YIFTGYFIH |
| 340 | 5428 | 1732 | TACATCTTCACCGGTTATTTTATACAC |
| 340 | 5429 | 1733 | VINPRGGSTSYAQKFQG |
| 340 | 5430 | 1734 | GTAATCAATCCCAGAGGTGGAAGCACAAGCTACGCAC AAAAGTTCCAGGGC |
| 340 | 5431 | 1735 | ARAPSHDEWVAISRNNDVVGFDA |
| 340 | 5432 | 1736 | GCGAGAGCCCCGAGCCACGATGAGTGGGTCGCAATTT CCCGAAATAACGATGTTGTGGGGTTCGACGCC |
| 340 | 5433 | 1737 | CAGTCTGTCCTGACTCAGCCGCCCTCAGTGTCTGGGGC CCCAGGGCAGAGGGTCACCATCTCCTGCACTGGGGGC AGCTCCAACATCGGGGCAGATTATGACGTACACTGGT ACCAGCAGCCTCCAGGAACAGCCCCCAAACTCCTCAT ATTTGCTAACAACAATCGACCCTCAGGGGTCCCTGGC CGATTCTCTGGCTCCAAGTCTGGCACCTCAGCCTCCCT GGCCATCACTGGGCTCCAGGCTGAGGATGAGGCTGAT TATTACTGCCAGTCCTATGACAGCAGCCTGAGTGCTTG GGTGTTCGGCGGGGGGACCAAGCTGACCGTCCTA |
| 340 | 5434 | 1738 | QSVLTQPPSVSGAPGQRVTISCTGGSSNIGADYDVHWYQ QPPGTAPKLLIFANNNRPSGVPGRFSGSKSGTSASLAITG LQAEDEADYYCQSYDSSLSAWVFGGGTKLTVL |
| 340 | 5435 | 1739 | TGGSSNIGADYDVH |
| 340 | 5436 | 1740 | ACTGGGGGCAGCTCCAACATCGGGGCAGATTATGACG TACAC |
| 340 | 5437 | 1741 | ANNNRPS |
| 340 | 5438 | 1742 | GCTAACAACAATCGACCCTCA |
| 340 | 5439 | 1743 | QSYDSSLSAWV |
| 340 | 5440 | 1744 | CAGTCCTATGACAGCAGCCTGAGTGCTTGGGTG |
| 341 | 5441 | 1745 | GAGGTGCAGCTGGTGGAGTCTGGGGGAGGCCTGGTCA AGCCTGGGGGGTCCCTGAGACTCTCCTGTGCAGCCTC TGGATTCACCCTCAGTAGTTATGCCATGAACTGGGTCC GCCAGGCTCCAGGGAAGGGTCTGGAGTGGGTCTCATC CATTAGTGCTGGAAGTAGTTACATCGACTACGCAGAC TCAGTGAAGGGCCGATTCACCATCTCCAGAGACAACG CCAAGAACTCTCTGTATCTGCAAATGAACAACCTGAG AGCCGAGGACACGGCTCTGTATTACTGTGCGAGAGAA GTTTTACCAGCAACCGCTATAGGAGGCGCCTGGCTCG ACCCCTGGGGCCAGGGAACCCTGGTCACTGTCTCCTC A |
| 341 | 5442 | 1746 | EVQLVESGGGLVKPGGSLRLSCAASGFTLSSYAMNWVR QAPGKGLEWVSSISAGSSYIDYADSVKGRFTISRDNAKN SLYLQMNNLRAEDTALYYCAREVLPATAIGGAWLDPW GQGTLVTVSS |
| 341 | 5443 | 1747 | FTLSSYAMN |
| 341 | 5444 | 1748 | TTCACCCTCAGTAGTTATGCCATGAAC |
| 341 | 5445 | 1749 | SISAGSSYIDYADSVKG |

TABLE 6-continued

Informal Sequence Listing

| Antibody No. | Seq. Ref. No. | SEQ ID NO. | Sequence |
|---|---|---|---|
| 341 | 5446 | 1750 | TCCATTAGTGCTGGAAGTAGTTACATCGACTACGCAGACTCAGTGAAGGGC |
| 341 | 5447 | 1751 | AREVLPATAIGGAWLDP |
| 341 | 5448 | 1752 | GCGAGAGAAGTTTTACCAGCAACCGCTATAGGAGGCGCCTGGCTCGACCCC |
| 341 | 5449 | 1753 | CAGTCTGTCCTGACGCAGCCGCCCTCAGTGTCTGGGGCCCCAGGGCAGACGGTCACCATCTCCTGCACTGGGAGCAGCTCCAACATCGGGGCTGGATATGATGTCCACTGGTACCGGCAGCTTCCAGGAACAGCCCCCAAACTCCTCATCTATTCTAACAACAATCGGCCCTCAGGGGTCCCTGACCGATTCTCTGGCTCCAAGTCTGACACCTCAGCCTCCCTGGCCATCACTGGGCTCCAGGCTGGGGATGAGGCTGATTATTACTGCCAGTCCTATGACATCAGCCTGAGTGCCTCTTATGTCTTCGGAACTGGGACCAAGGTCACCGTCCTA |
| 341 | 5450 | 1754 | QSVLTQPPSVSGAPGQTVTISCTGSSSNIGAGYDVHWYRQLPGTAPKLLIYSNNNRPSGVPDRFSGSKSDTSASLAITGLQAGDEADYYCQSYDISLSASYVFGTGTKVTVL |
| 341 | 5451 | 1755 | TGSSSNIGAGYDVH |
| 341 | 5452 | 1756 | ACTGGGAGCAGCTCCAACATCGGGGCTGGATATGATGTCCAC |
| 341 | 5453 | 1757 | SNNNRPS |
| 341 | 5454 | 1758 | TCTAACAACAATCGGCCCTCA |
| 341 | 5455 | 1759 | QSYDISLSASYV |
| 341 | 5456 | 1760 | CAGTCCTATGACATCAGCCTGAGTGCCTCTTATGTC |
| 342 | 5457 | 1761 | CAGGTCCAGCTGGTGCAGTCTGGAGCTGAGGTGAAGAAGCCTGGGGCCTCAGTGAAGGTCTCCTGCAAGGCTTCTGGTTACACCTTTACCAACTATGGTTTCAGCTGGGTGCGACAGGCCCCTGGACAAGGGCTTGAGTGGATGGGATGGATCCTCACTCACAATGGTTACACAAACTATGCACAGAAGTTCCAGGACAGAGTCACCATGAAGACAGACACATCCACGAGCACAGTCTACATGGAGCTGAGGAGCCTGAGATCTGTCGACACGGCCGTGTATTACTGTGCGAGAATTGGCCATGTTACAGCCGTGGCTGGTGCCCCTCCTGACTACTGGGGCCAGGGAACCCTGGTCACCGTCTCCTCA |
| 342 | 5458 | 1762 | QVQLVQSGAEVKKPGASVKVSCKASGYTFTNYGFSWVRQAPGQGLEWMGWILTHNGYTNYAQKFQDRVTMKTDTSTSTVYMELRSLRSVDTAVYYCARIGHVTAVAGAPPDYWGQGTLVTVSS |
| 342 | 5459 | 1763 | YTFTNYGFS |
| 342 | 5460 | 1764 | TACACCTTTACCAACTATGGTTTCAGC |
| 342 | 5461 | 1765 | WILTHNGYTNYAQKFQD |
| 342 | 5462 | 1766 | TGGATCCTCACTCACAATGGTTACACAAACTATGCACAGAAGTTCCAGGAC |
| 342 | 5463 | 1767 | ARIGHVTAVAGAPPDY |
| 342 | 5464 | 1768 | GCGAGAATTGGCCATGTTACAGCCGTGGCTGGTGCCCCTCCTGACTAC |
| 342 | 5465 | 1769 | CAGCCTGTGCTGACTCAGCCTGCCTCCGTGTCTGGGTATCAAGGACAGTCGATCACCATCTCCTGCAGTGGAACCAGCAGTGATGTGGGACTTATAACCTTGTCTCCTGGTACCAACAACACCCAGGCAAAGCCCCCGAACTCATGATTTATGAGGGCAGTAAGCGGCCCTCAGGGGTTTCTGATCGCTTCTCTGGCTCCAAGTCTGGCAACACGGCCTCCCTGACAATCTCTGGGCTCCAGGCTGAGGACGAGGCTGATTATTACTGCTGCTCATATGTAGCTGGTAGTACTTCAGTATTCGGCGGAGGGACCAAGCTCACCGTCCTA |

TABLE 6-continued

Informal Sequence Listing

| Antibody No. | Seq. Ref. No. | SEQ ID NO. | Sequence |
|---|---|---|---|
| 342 | 5466 | 1770 | QPVLTQPASVSGYQGQSITISCSGTSSDVGTYNLVSWYQ QHPGKAPELMIYEGSKRPSGVSDRFSGSKSGNTASLTISG LQAEDEADYYCCSYVAGSTSVFGGGTKLTVL |
| 342 | 5467 | 1771 | SGTSSDVGTYNLVS |
| 342 | 5468 | 1772 | AGTGGAACCAGCAGTGATGTTGGGACTTATAACCTTG TCTCC |
| 342 | 5469 | 1773 | EGSKRPS |
| 342 | 5470 | 1774 | GAGGGCAGTAAGCGGCCCTCA |
| 342 | 5471 | 1775 | CSYVAGSTSV |
| 342 | 5472 | 1776 | TGCTCATATGTAGCTGGTAGTACTTCAGTA |
| 343 | 5473 | 1777 | GAGGTGCAGCTGGTGGAGTCGGGCCCTGGACTGGTGA AGCCTTCAGAGACCCTGTCCCTCAGTTGCATTGTCTCT GGTGGCTCCATCACCAGTGGTGATTACTACTGGAGTT GGCTCCGCCAGTCCCCAGGGAAGGGCCTGGAGTGGAT TGGGTACATATATCACAGCGGGGCCACCTTCTACACC CCGTCCCTACGGAGTCGAGTGACCATTTCGACAGACA CCTCCAAGAACCAATTCTCCCTGAGACTGTCGTCTGTG ACCGCCGCAGACACGGCCGTTTATTATTGTGCCAGTG GACCTGTCGGGATGGCTACAAGCAACTGGTTCGACCC CTGGGGCCAGGGAACCCTGGTCACCGTCTCCTCA |
| 343 | 5474 | 1778 | EVQLVESGPGLVKPSETLSLSCIVSGGSITSGDYYWSWLR QSPGKGLEWIGYIYHSGATFYTPSLRSRVTISTDTSKNQF SLRLSSVTAADTAVYYCASGPVGMATSNWFDPWGQGT LVTVSS |
| 343 | 5475 | 1779 | GSITSGDYYWS |
| 343 | 5476 | 1780 | GGCTCCATCACCAGTGGTGATTACTACTGGAGT |
| 343 | 5477 | 1781 | YIYHSGATFYTPSLRS |
| 343 | 5478 | 1782 | TACATATATCACAGCGGGGCCACCTTCTACACCCCGT CCCTACGGAGT |
| 343 | 5479 | 1783 | ASGPVGMATSNWFDP |
| 343 | 5480 | 1784 | GCCAGTGGACCTGTCGGGATGGCTACAAGCAACTGGT TCGACCCC |
| 343 | 5481 | 1785 | TCCTATGAGCTGACACAGCCACCCTCAGTATCAGTCG CCCCGGGAAAGACGGCCACCATTACGTGTGGGGGAG ACATCATTAGAACTAACAGTGTGAACTGGTACCAGCA GAAGCCAGGCCAGGCCCCTCTATTGCTCATCTATTATG ATAGCGACCGGCCCTCAGGGATCCCTGAGCGATTCTC TGCCTCCAACTCTGGGAACACGGCCACCCTGACCATC AGCAGGGTCGAGGCCGGGGATGAGGCCGACTATTACT GTCAGGTGTGGGACAGTGGTACTGATTATCACGTGGT TTTCGGCGGAGGGACCAAGCTGACCGTCCAA |
| 343 | 5482 | 1786 | SYELTQPPSVSVAPGKTATITCGGDIIRTNSVNWYQQKP GQAPLLLIYYDSDRPSGIPERFSASNSGNTATLTISRVEAG DEADYYCQVWDSGTDYHVVFGGGTKLTVQ |
| 343 | 5483 | 1787 | GGDIIRTNSVN |
| 343 | 5484 | 1788 | GGGGGAGACATCATTAGAACTAACAGTGTGAAC |
| 343 | 5485 | 1789 | YDSDRPS |
| 343 | 5486 | 1790 | TATGATAGCGACCGGCCCTCA |
| 343 | 5487 | 1791 | QVWDSGTDYHVV |
| 343 | 5488 | 1792 | CAGGTGTGGGACAGTGGTACTGATTATCACGTGGTT |
| 344 | 5489 | 1793 | CAGGTCCAGCTGGTACAGTCTGGGGCTGAGGTGAAGA GGCCTGGGGCCTCAGTGAAAGTCTCCTGCAAGGCTTC |

TABLE 6-continued

Informal Sequence Listing

| Antibody No. | Seq. Ref. No. | SEQ ID NO. | Sequence |
|---|---|---|---|
| | | | TGAATACGCCTTCACCGCCCACTATCTTCACTGGGTGC GACAGGCCCCTGATCAAGGACTTGAGTGGATGGGATG GATCAGCCCTAAAAGTGGTGGCACCAACTATGCACAG AAGTTTCACGGCAGGGTCAGCATGACCAGTGACACGT CCATCAGTACAGTCTATATGGAACTGAGCAGCCTGAC ATCTGACGACACGGCCGTCTATTACTGTGCGAGAAGC AGTCTGGTGGGAGCAAGCCCCAACTTTGACTTCTGGG GCCAGGGAACCCTGGTCACCGTCTCCTCA |
| 344 | 5490 | 1794 | QVQLVQSGAEVKRPGASVKVSCKASEYAFTAHYLHWV RQAPDQGLEWMGWISPKSGGTNYAQKFHGRVSMTSDT SISTVYMELSSLTSDDTAVYYCARSSLVGASPNFDFWGQ GTLVTVSS |
| 344 | 5491 | 1795 | YAFTAHYLH |
| 344 | 5492 | 1796 | TACGCCTTCACCGCCCACTATCTTCAC |
| 344 | 5493 | 1797 | WISPKSGGTNYAQKFHG |
| 344 | 5494 | 1798 | TGGATCAGCCCTAAAAGTGGTGGCACCAACTATGCAC AGAAGTTTCACGGC |
| 344 | 5495 | 1799 | ARSSLVGASPNFDF |
| 344 | 5496 | 1800 | GCGAGAAGCAGTCTGGTGGGAGCAAGCCCCAACTTTG ACTTC |
| 344 | 5497 | 1801 | CAGTCTGTGGTGACGCAGCCGCCCTCAGTGTCTGCGG CCCCAGGACAGAGGGTCACCATCTCCTGCTCTGGAAG CAGCTCCAACATTGGGAATAATTATGTATCCTGGTAC CAGCAACTCCCAGGATCTACCCCCAAAGTCCTCATTT ACGACAATAATCAGCGACCCTCAGGGATTCCTGACCG TTTCTCTGGCTCCAAGTCTGGCACGTCAGCCACCCTGG CCATCAGCGGACTCCAGACTGGCGACGAGGCCGTCTA TTATTGCGGAACATGGGATGCCAGCCTGAGTGCTGCA ATGGTTTTCGGCGGGGGGACCAAGCTCACCGTCCTA |
| 344 | 5498 | 1802 | QSVVTQPPSVSAAPGQRVTISCSGSSSNIGNNYVSWYQQ LPGSTPKVLIYDNNQRPSGIPDRFSGSKSGTSATLAISGLQ TGDEAVYYCGTWDASLSAAMVFGGGTKLTVL |
| 344 | 5499 | 1803 | SGSSSNIGNNYVS |
| 344 | 5500 | 1804 | TCTGGAAGCAGCTCCAACATTGGGAATAATTATGTAT CC |
| 344 | 5501 | 1805 | DNNQRPS |
| 344 | 5502 | 1806 | GACAATAATCAGCGACCCTCA |
| 344 | 5503 | 1807 | GTWDASLSAAMV |
| 344 | 5504 | 1808 | GGAACATGGGATGCCAGCCTGAGTGCTGCAATGGTT |
| 345 | 5505 | 1809 | CAGGTGCAGCTACAGCAGTGGGGCGCAGGACTGTTGA AGCCTTCGGAGACCCTGTCCCTAACCTGCGCTGTCTCT GGTGGGTACTTCATTAATGACAACTGGAGCTGGATCC GCCAGTCCCCAGGGAAGGGGCTGGAGTGGATTGGAG AAATTAGTCATAGTGGAAGCACCAACTACAATCCGTC CCTCAAGAGTCGACTCACCATATCAGTTGACACGTCC AGGCAGCAGTTTTCCCTGAAATTGAGCTCTGTGACCG CCGCGGACAGTGGTGTTTACTACTGTGCGCGAGTCCA CCCGTCGTATGACTTTGGCTGGCGCTTCTTTGACTTCT GGGGCCAGGGAACCCTGGTCACCGTCTCTTCA |
| 345 | 5506 | 1810 | QVQLQQWGAGLLKPSETLSLTCAVSGGYFINDNWSWIR QSPGKGLEWIGEISHSGSTNYNPSLKSRLTISVDTSRQQFS LKLSSVTAADSGVYYCARVHPSYDFGWRFFDFWGQGTL VTVSS |
| 345 | 5507 | 1811 | GYFINDNWS |
| 345 | 5508 | 1812 | GGGTACTTCATTAATGACAACTGGAGC |

TABLE 6-continued

Informal Sequence Listing

| Antibody No. | Seq. Ref. No. | SEQ ID NO. | Sequence |
|---|---|---|---|
| 345 | 5509 | 1813 | EISHSGSTNYNPSLKS |
| 345 | 5510 | 1814 | GAAATTAGTCATAGTGGAAGCACCAACTACAATCCGT<br>CCCTCAAGAGT |
| 345 | 5511 | 1815 | ARVHPSYDFGWRFFDF |
| 345 | 5512 | 1816 | GCGCGAGTCCACCCGTCGTATGACTTTGGCTGGCGCTT<br>CTTTGACTTC |
| 345 | 5513 | 1817 | GAAACGACACTCACGCAGTCTCCAGCCACCCTGTCTG<br>TGTCTCCAGGGGATACAGCCACCCTCTCCTGCAGGGC<br>CAGTCAGACTATTAGTTCCAACTTAGCCTGGTACCAG<br>CAGAAACCTGGCCAGCCTCCCAGTCCTCATCTATG<br>GAGCATCCAACAGGGCCACTGGTATCCCAGACAGGTT<br>TCGTGGCAGTGGGTCTGGGACAGAGTTCACTCTCACC<br>ATCAGCAGCCTGCAGTCTGAAGATTTTGCAGTTTATTA<br>CTGTCAGCAGTATGCATACTGGCCTCCGTACACTTTTG<br>GCCAGGGGACCAAGGTGGAGATCAAA |
| 345 | 5514 | 1818 | ETTLTQSPATLSVSPGDTATLSCRASQTISSNLAWYQQKP<br>GQPPSLLIYGASNRATGIPDRFRGSGSGTEFTLTISSLQSE<br>DFAVYYCQQYAYWPPYTFGQGTKVEIK |
| 345 | 5515 | 1819 | RASQTISSNLA |
| 345 | 5516 | 1820 | AGGGCCAGTCAGACTATTAGTTCCAACTTAGCC |
| 345 | 5517 | 1821 | GASNRAT |
| 345 | 5518 | 1822 | GGAGCATCCAACAGGGCCACT |
| 345 | 5519 | 1823 | QQYAYWPPYT |
| 345 | 5520 | 1824 | CAGCAGTATGCATACTGGCCTCCGTACACT |
| 346 | 5521 | 1825 | GAGGTGCAGCTGTTGGAGTCGGGCCCAGGACTGGTGA<br>AGCCTTCACAGACCCTGTCCCTCACCTGCACTGTCTCG<br>GGTGGCTCCATCAACAGTATTGATTATTATTGGAGCTG<br>GATCCGCCAGCCCCCAGGGAAGGGCCTGGAGTGGATT<br>GGCTACATTTATCACAGTGGGAGCACCCACTACAGAC<br>CATCCCTCAAGAGTCGAGTAACGATATCATTAGACAA<br>GGCCAAGAACGAGTTCTCGCTGAGTCTGACCTCTGTG<br>ACTGCCGCAGACACGGCCGTGTATTTCTGTGCCAGTG<br>GCCCCGTCGGGATGGCAACAAGCAACTGGTTCGACCCC<br>CTGGGGCCAGGGAACCCTGGTCACCGTCTCCTCA |
| 346 | 5522 | 1826 | EVQLLESGPGLVKPSQTLSLTCTVSGGSINSIDYYWSWIR<br>QPPGKGLEWIGYIYHSGSTHYRPSLKSRVTISLDKAKNEF<br>SLSLTSVTAADTAVYFCASGPVGMATSNWFDPWGQGTL<br>VTVSS |
| 346 | 5523 | 1827 | GSINSIDYYWS |
| 346 | 5524 | 1828 | GGCTCCATCAACAGTATTGATTATTATTGGAGC |
| 346 | 5525 | 1829 | YIYHSGSTHYRPSLKS |
| 346 | 5526 | 1830 | TACATTTATCACAGTGGGAGCACCCACTACAGACCAT<br>CCCTCAAGAGT |
| 346 | 5527 | 1831 | ASGPVGMATSNWFDP |
| 346 | 5528 | 1832 | GCCAGTGGCCCCGTCGGGATGGCAACAAGCAACTGGT<br>TCGACCCC |
| 346 | 5529 | 1833 | CAGCCTGTGCTGACTCAGCCACCCTCAGTGTCAGTGA<br>CCCCAGGAGAGACGGCCAGGCTTCCCTGTGAGGGAGA<br>CATCGTTGTCACTAACAGTGTCCACTGGTACCAGCAG<br>AAGCCAGGCCAGGCCCCTGTTTTGGTCGTCTATTATGA<br>TAGCGACCGGGCCTCAGGGATCCCTGAGCGATTCTCT<br>GGCTCCAATTCTGGGAACACGGCCACCCTGAGCATCA<br>GCAGGGTCGAAGCCGGGGATGAGGCCGACTACTATTG<br>TCAGGTGTGGGATAGTAGTACTGATCATCATGTGGTG<br>TTCGGCGGTGGGACCAAGCTCACCGTCCTA |

TABLE 6-continued

Informal Sequence Listing

| Antibody No. | Seq. Ref. No. | SEQ ID NO. | Sequence |
|---|---|---|---|
| 346 | 5530 | 1834 | QPVLTQPPSVSVTPGETARLPCEGDIVVTNSVHWYQQKPGQAPVLVVYYDSDRASGIPERFSGSNSGNTATLSISRVEAGDEADYYCQVWDSSTDHHVVFGGGTKLTVL |
| 346 | 5531 | 1835 | EGDIVVTNSVH |
| 346 | 5532 | 1836 | GAGGGAGACATCGTTGTCACTAACAGTGTCCAC |
| 346 | 5533 | 1837 | YDSDRAS |
| 346 | 5534 | 1838 | TATGATAGCGACCGGGCCTCA |
| 346 | 5535 | 1839 | QVWDSSTDHHVV |
| 346 | 5536 | 1840 | CAGGTGTGGGATAGTAGTACTGATCATCATGTGGTG |
| 347 | 5537 | 1841 | CAGGTCCAGCTGGTGCAGTCTGGGGCTGAGGTGAAGAAGCCTGGGTCCTCGGTGAAGGTCTCCTGCAAGGCTTCTGGAGGCAGATTCAGCAGCGACGCTATCAGCTGGGTGCGACAGGCCCCTGGACAAGGGCTTGAGTGGATGGGAGGAATCATCCCTATCCGTGGGACACCAACCTACGCACAGAAGTTCCAGGGCAGAGTCACGATTATCGCGGACGAATCCACGACTACATCCTACATGGAGATGAGCAGCCTGAGATCTGAGGACACGGCCGTGTATTACTGTGCGAGACCGAATTACGATATTTTGACTGGTTATAATGATGCTTTTGATATTTGGGGCCAAGGGACAATGGTCACCGTCTCTTCA |
| 347 | 5538 | 1842 | QVQLVQSGAEVKKPGSSVKVSCKASGGRFSSDAISWVRQAPGQGLEWMGGIIPIRGTPTYAQKFQGRVTIIADESTTTSYMEMSSLRSEDTAVYYCARPNYDILTGYNDAFDIWGQGTMVTVSS |
| 347 | 5539 | 1843 | GRFSSDAIS |
| 347 | 5540 | 1844 | GGCAGATTCAGCAGCGACGCTATCAGC |
| 347 | 5541 | 1845 | GIIPIRGTPTYAQKFQG |
| 347 | 5542 | 1846 | GGAATCATCCCTATCCGTGGGACACCAACCTACGCACAGAAGTTCCAGGGC |
| 347 | 5543 | 1847 | ARPNYDILTGYNDAFDI |
| 347 | 5544 | 1848 | GCGAGACCGAATTACGATATTTTGACTGGTTATAATGATGCTTTTGATATT |
| 347 | 5545 | 1849 | CAGTCTGTGTTGACGCAGCCTCGCTCAGTGTCCGGGTCTCCTGGACAGTCAGTCACCATCTCCTGCACTGGAACCAGCAGTGATGTTGGTGGTTATAACTATGTCTCCTGGTACCAACAGCACCCAGGCAAAGTCCCCAGACTCATGATTTACGATGTCAGTAAGCGGCCCTCAGGGGCCCCTGATCGCTTCTCTGGCTCCAAGTCTGGCAACACGGCCTCCCTGACCATCTCTGGGCTCCAGGCTGAGGATGAGGCTGATTATTACTGCTGCTCATATGCAGGCGGCCTTTATGTCTTCGGAACTGGGACCAAGCTCACCGTCCTA |
| 347 | 5546 | 1850 | QSVLTQPRSVSGSPGQSVTISCTGTSSDVGGYNYVSWYQQHPGKVPRLMIYDVSKRPSGAPDRFSGSKSGNTASLTISGLQAEDEADYYCCSYAGGLYVFGTGTKLTVL |
| 347 | 5547 | 1851 | TGTSSDVGGYNYVS |
| 347 | 5548 | 1852 | ACTGGAACCAGCAGTGATGTTGGTGGTTATAACTATGTCTCC |
| 347 | 5549 | 1853 | DVSKRPS |
| 347 | 5550 | 1854 | GATGTCAGTAAGCGGCCCTCA |
| 347 | 5551 | 1855 | CSYAGGLYV |
| 347 | 5552 | 1856 | TGCTCATATGCAGGCGGCCTTTATGTC |

TABLE 6-continued

Informal Sequence Listing

| Antibody No. | Seq. Ref. No. | SEQ ID NO. | Sequence |
|---|---|---|---|
| 348 | 5553 | 1857 | GAGGTGCAGCTGGTGGAGTCCGGGGCTGAGGTGAAG AAGCCTGGGGCCTCAGTGAAGGTCTCCTGCAAGGCTT CTGGATACACCTTCACCACTTATGATATCAACTGGGTG CGACAGGCCACTGGACGGGGGCTTGAGTGGATGGGAT GGATGACCCCTGATAGTGGTAGCACAGGCTATCCACA GAACTTCCAGGGCAGAGTCACCATGACCAGGAACACC TCCATAAGCACAGCCTACATGGAGTTGAGCAACCTGA GATCTGAGGACACGGCCGTATATTACTGTGTGCAAAT GGACCATTGTAGAAGTACCAGCTGCTCTGAGGGGAAC TGGTTCGACACCTGGGGCCAGGGAACCCTGGTCACCG TCTCCTCA |
| 348 | 5554 | 1858 | EVQLVESGAEVKKPGASVKVSCKASGYTFTTYDINWVR QATGRGLEWMGWMTPDSGSTGYPQNFQGRVTMTRNTS ISTAYMELSNLRSEDTAVYYCVQMDHCRSTSCSEGNWF DTWGQGTLVTVSS |
| 348 | 5555 | 1859 | YTFTTYDIN |
| 348 | 5556 | 1860 | TACACCTTCACCACTTATGATATCAAC |
| 348 | 5557 | 1861 | WMTPDSGSTGYPQNFQG |
| 348 | 5558 | 1862 | TGGATGACCCCTGATAGTGGTAGCACAGGCTATCCAC AGAACTTCCAGGGC |
| 348 | 5559 | 1863 | VQMDHCRSTSCSEGNWFDT |
| 348 | 5560 | 1864 | GTGCAAATGGACCATTGTAGAAGTACCAGCTGCTCTG AGGGGAACTGGTTCGACACC |
| 348 | 5561 | 1865 | CAGCCTGGGCTGACTCAGCCACCCTCGGTGTCTGCAG CCCCCAGGCAGAGGGTCACCATCTCCTGTTCTGGAAG CAGCTCCAACATCGGAACTAATGCTGTAAACTGGTAC CAGCAGCTCCCAGGAAAGGCTCCCAAACTCCTCATCT ATTCTGATAATCTGATGCCCTCAGGGGTCTCTGCCCGA TTCTCTGGCTCCAAGTCTGGCACCTCGGCCTCCCTGGC CATCAGTGGGCTCCAGTCTGAGGATGAGGCTGATTAT TACTGTGCAGCATGGGATGACAGCCTGAATGTTTGGG TGTTCGGCGGGGGGACCAAGCTCACCGTCCTA |
| 348 | 5562 | 1866 | QPGLTQPPSVSAAPRQRVTISCSGSSSNIGTNAVNWYQQ LPGKAPKLLIYSDNLMPSGVSARFSGSKSGTSASLAISGL QSEDEADYYCAAWDDSLNVWVFGGGTKLTVL |
| 348 | 5563 | 1867 | SGSSSNIGTNAVN |
| 348 | 5564 | 1868 | TCTGGAAGCAGCTCCAACATCGGAACTAATGCTGTAA AC |
| 348 | 5565 | 1869 | SDNLMPS |
| 348 | 5566 | 1870 | TCTGATAATCTGATGCCCTCA |
| 348 | 5567 | 1871 | AAWDDSLNVWV |
| 348 | 5568 | 1872 | GCAGCATGGGATGACAGCCTGAATGTTTGGGTG |
| 349 | 5569 | 1873 | GAGGTGCAGCTGGTGGAGTCTGGGGGAGGCTTGGTGA AGCCAGGGCGGTCCCTGAGACTCTCCTGTACAGCCTC TGGATTCAACTTCGGTGATTATGCTATGAGCTGGTTCC GCCAGGCTCCAGGGAAGGGGCTGGAGTGGGTAGGTTT CATTAGAAGCAAAACTTATCGTGAGACAAGAGAATAC GCCGCGTCTGTGAAAGGCAGATTCACCATGTCAAGAG ATGATTTCAACAGGATCGCCTATCTGCAAATGAACAG CCTGAAAACCGAGGACACAGCCATGTATTATTGTACG AGACAAGACGATTTTTGGAGTGGTCATCCCTACTACTT TGAGTACTGGGGCCAGGGAACCCTGGTCACCGTCTCC TCA |
| 349 | 5570 | 1874 | EVQLVESGGGLVKPGRSLRLSCTASGFNFGDYAMSWFR QAPGKGLEWVGFIRSKTYRETREYAASVKGRFTMSRDD FNRIAYLQMNSLKTEDTAMYYCTRQDDFWSGHPYYFEY WGQGTLVTVSS |

TABLE 6-continued

Informal Sequence Listing

| Antibody No. | Seq. Ref. No. | SEQ ID NO. | Sequence |
|---|---|---|---|
| 349 | 5571 | 1875 | FNFGDYAMS |
| 349 | 5572 | 1876 | TTCAACTTCGGTGATTATGCTATGAGC |
| 349 | 5573 | 1877 | FIRSKTYRETREYAASVKG |
| 349 | 5574 | 1878 | TTCATTAGAAGCAAAACTTATCGTGAGACAAGAGAAT ACGCCGCGTCTGTGAAAGGC |
| 349 | 5575 | 1879 | TRQDDFWSGHPYYFEY |
| 349 | 5576 | 1880 | ACGAGACAAGACGATTTTTGGAGTGGTCATCCCTACT ACTTTGAGTAC |
| 349 | 5577 | 1881 | CAGCCTGTGCTGACTCAGCCCCCCTCCGCGTCCGGGTC TCCTGGACAGTCAGTCACCATCTCCTGCACTGGAACC AACAGTGACGTGGGTAGTTATAACTATGTCTCCTGGT ACCAACATCACCCAGGCAAAGCCCCCAAACTCATCAT TTATGACGTCGCTAAGCGGCCCTCAGGGGTCCCTGAT CGCTTCTCTGGCTCCAAGTCTGGCAACACGGCCTCCCT GACCGTCTCTGGGCTCCAGGCTGAGGATGAGGCTGAT TATTACTGCAGCTCATATGCAGGCAGTAACGATTTGG GGGTCTTCGGAACTGGGACCAAGCTCACCGTCCTA |
| 349 | 5578 | 1882 | QPVLTQPPSASGSPGQSVTISCTGTNSDVGSYNYVSWYQ HHPGKAPKLIIYDVAKRPSGVPDRFSGSKSGNTASLTVS GLQAEDEADYYCSSYAGSNDLGVFGTGTKLTVL |
| 349 | 5579 | 1883 | TGTNSDVGSYNYVS |
| 349 | 5580 | 1884 | ACTGGAACCAACAGTGACGTGGGTAGTTATAACTATG TCTCC |
| 349 | 5581 | 1885 | DVAKRPS |
| 349 | 5582 | 1886 | GACGTCGCTAAGCGGCCCTCA |
| 349 | 5583 | 1887 | SSYAGSNDLGV |
| 349 | 5584 | 1888 | AGCTCATATGCAGGCAGTAACGATTTGGGGGTC |
| 350 | 5585 | 1889 | GAGGTGCAGCTGGTGGAGTCCGGCCCAGGACTGGTGA AGCCTTCGGAGACCCTGTCCCTCACCTGCACTGTGTCT GGTGGCTCCGTCAGTGGTCACTACTGGAGCTGGATTC GGCAGTTCCCAGGGAAGGAACTGGAATGGATTGGTCA TATCTATTATATTGGGACGACCAACTACAACCCCTCCC TCAAGAGTCGAGTCATCATATCGCTAGACACGTCCAA GAATCAGCTCTCCCTGAAGCTGAGTTCTGTGACCGCT GCGGACACTGCCGTTTATTATTGTGCCAGACAGTTCG GCTATGATAAAAATACTTTAAGTCGGCTTGACTTTGAC TACTGGGGCCAGGGAACCCTGGTCACCGTCTCCTCA |
| 350 | 5586 | 1890 | EVQLVESGPGLVKPSETLSLTCTVSGGSVSGHYWSWIRQ FPGKELEWIGHIYYIGTTNYNPSLKSRVIISLDTSKNQLSL KLSSVTAADTAVYYCARQFGYDKNTLSRLDFDYWGQG TLVTVSS |
| 350 | 5587 | 1891 | GSVSGHYWS |
| 350 | 5588 | 1892 | GGCTCCGTCAGTGGTCACTACTGGAGC |
| 350 | 5589 | 1893 | HIYYIGTTNYNPSLKS |
| 350 | 5590 | 1894 | CATATCTATTATATTGGGACGACCAACTACAACCCCTC CCTCAAGAGT |
| 350 | 5591 | 1895 | ARQFGYDKNTLSRLDFDY |
| 350 | 5592 | 1896 | GCCAGACAGTTCGGCTATGATAAAAATACTTTAAGTC GGCTTGACTTTGACTAC |
| 350 | 5593 | 1897 | GACATCCAGATGACCCAGTCTCCATCCTCCCTGTCTGC ATCTGTAAGAGACAGAGTCACCATCACTTGCCGGGCA AGTCAGAGCATTAGCAGCTATTTAAATTGGTATCAAC AGAGACCAGGGAAAGCCCCTAAGCTCCTGATCTATTC |

TABLE 6-continued

Informal Sequence Listing

| Antibody No. | Seq. Ref. No. | SEQ ID NO. | Sequence |
|---|---|---|---|
|  |  |  | TGCATTCAGTTTACATAGTGGTGTCCCATCAAGGTTCA GTGGCAGTGGATCTGAGACAGAGTTCACTCTCACCAT CAGCAGTCTGCAACCTGACGATTTTGCAACTTATTACT GTCAACAGAGTTACAGTATTCCCTGGACGTTCGGCCA AGGGACCAAGGTGGAAATCAAA |
| 350 | 5594 | 1898 | DIQMTQSPSSLSASVRDRVTITCRASQSISSYLNWYQQRP GKAPKLLIYSAFSLHSGVPSRFSGSGSETEFTLTISSLQPD DFATYYCQQSYSIPWTFGQGTKVEIK |
| 350 | 5595 | 1899 | RASQSISSYLN |
| 350 | 5596 | 1900 | CGGGCAAGTCAGAGCATTAGCAGCTATTTAAAT |
| 350 | 5597 | 1901 | SAFSLHS |
| 350 | 5598 | 1902 | TCTGCATTCAGTTTACATAGT |
| 350 | 5599 | 1903 | QQSYSIPWT |
| 350 | 5600 | 1904 | CAACAGAGTTACAGTATTCCCTGGACG |
| 351 | 5601 | 1905 | CAGGTGCAGCTGCAGGAGTCCGGCCCGGGACTGGTGA AGCCTTCGGAGACCCTGTCCCTCACCTGCAGTGTCTCT GGTGGCTCCATCACCAATGTTAATTACTACTGGGGCT GGATCCGCCAGCCCCCGGGAAGGGCCTGGAGTGGAT TGGGAGTATCTATTATAATGGAAACACCTACTACAAC CCGTCCCTCCAGAGTCGAGTCACCATGTCCGTGGACA CGTCCAAGAACCACTTCTCCCTGAGGCTGACGTCTGT GACCGCCGCAGACACGGCTGTATATTTTTGTGCGAGA GAGGGGGCCTAATTGGGAATTGTTGAATGCTTTCGATA TCTGGGGCCAAGGGACCACGGTCACCGTCTCCTCA |
| 351 | 5602 | 1906 | QVQLQESGPGLVKPSETLSLTCSVSGGSITNVNYYWGWI RQPPGKGLEWIGSIYYNGNTYYNPSLSRVTMSVDTSKN HFSLRLTSVTAADTAVYFCAREGPNWELLNAFDIWGQG TTVTVSS |
| 351 | 5603 | 1907 | GSITNVNYYWG |
| 351 | 5604 | 1908 | GGCTCCATCACCAATGTTAATTACTACTGGGGC |
| 351 | 5605 | 1909 | SIYYNGNTYYNPSLQS |
| 351 | 5606 | 1910 | AGTATCTATTATAATGGAAACACCTACTACAACCCGT CCCTCCAGAGT |
| 351 | 5607 | 1911 | AREGPNWELLNAFDI |
| 351 | 5608 | 1912 | GCGAGAGAGGGGCCTAATTGGGAATTGTTGAATGCTT TCGATATC |
| 351 | 5609 | 1913 | TCCTATGAGCTGACTCAGCCACCCTCGGTGTCAGTGG CCCCAGGACAGACGGCCAGGATTACCTGTGGGGGAA ACAACATTGGAAGTAAAAATGTGCACTGGTACCAGCA GAAGCCAGGCCAGGCCCCTGTCTTGGTCGTCTATGAG GATACCCACCGGCCCTCAGGGATCCCTGAGCGATTCT CTGGCTCCAACTCTGGGAACACGGCCACCCTGACCAT CAGTAGGGTCGAAGCGGGGATGAGGCCGACTATTAC TGTCAGGTGTGGGATACTAGTAGTGATCATGTGGTAT TCGGCGGAGGGACCAAGCTGACCGTCCTC |
| 351 | 5610 | 1914 | SYELTQPPSVSVAPGQTARITCGGNNIGSKNVHWYQQKP GQAPVLVVYEDTHRPSGIPERFSGSNSGNTATLTISRVEA GDEADYYCQVWDTSSDHVVFGGGTKLTVL |
| 351 | 5611 | 1915 | GGNNIGSKNVH |
| 351 | 5612 | 1916 | GGGGGAAACAACATTGGAAGTAAAAATGTGCAC |
| 351 | 5613 | 1917 | EDTHRPS |
| 351 | 5614 | 1918 | GAGGATACCCACCGGCCCTCA |
| 351 | 5615 | 1919 | QVWDTSSDHVV |

TABLE 6-continued

Informal Sequence Listing

| Antibody No. | Seq. Ref. No. | SEQ ID NO. | Sequence |
|---|---|---|---|
| 351 | 5616 | 1920 | CAGGTGTGGGATACTAGTAGTGATCATGTGGTA |
| 352 | 5617 | 1921 | CAGGTCCAGCTTGTGCAGTCTGGGGCTGAGGTGAAGA AGCCTGGGGCCTCAGTGAAGGTCTCCTGCAAGACTTC TGGTTACACCTTTAGTCATTTCGGTGTCACCTGGATAC GACAGGCCCCAGGACAAGGGCTTGAGTGGCTGGGAT GGATCAGCGCTTACAATGGTAACACAGACTCTGCAGA CAAACTGCAGGGCAGACTCACCATGACGACAGACAC ATCCACGAACACCGCCTACATGGAGTTGAGGAGCCTC AGATCTGACGACACGGCCGTCTATTACTGTGCGAGAG ATCCCCCCGCATCAGCTGCTGCCATGCTTGACTACTGG GGCCAGGGAACCCTGGTCACCGTCTCCTCA |
| 352 | 5618 | 1922 | QVQLVQSGAEVKKPGASVKVSCKTSGYTFSHFGVTWIR QAPGQGLEWLGWISAYNGNTDSADKLQGRLTMTTDTS TNTAYMELRSLRSDDTAVYYCARDPPASAAAMLDYWG QGTLVTVSS |
| 352 | 5619 | 1923 | YTFSHFGVT |
| 352 | 5620 | 1924 | TACACCTTTAGTCATTTCGGTGTCACC |
| 352 | 5621 | 1925 | WISAYNGNTDSADKLQG |
| 352 | 5622 | 1926 | TGGATCAGCGCTTACAATGGTAACACAGACTCTGCAG ACAAACTGCAGGGC |
| 352 | 5623 | 1927 | ARDPPASAAAMLDY |
| 352 | 5624 | 1928 | GCGAGAGATCCCCCCGCATCAGCTGCTGCCATGCTTG ACTAC |
| 352 | 5625 | 1929 | GACATCCAGATGACCCAGTCTCCACTCTCCCTGGCCGT CACCCTTGGACAGCCGGCCTCCATCTCCTGCAGGTCTA GTCAAGGCCTCGAATACACTGATGGAAACACCTACTT GAGTTGGTTTCAGCAGAGGCCAGGCCAATCTCCAAGG CGCCTCATTTATAAGGTTTCTAATCGGGACTCTGGGGT CCCAGACAGATTCAGCGGCAGCGGGGCAGGCACTGAT TTCACACTGAGAATCAGCAGGGTGGAGGCTGAGGATG TTGGGGTTTATTACTGCATGCAAGGTACACACGGGCG GGGAATCTCTTTCGGTCCTGGGACCAAAGTGGATATC AAA |
| 352 | 5626 | 1930 | DIQMTQSPLSLAVTLGQPASISCRSSQGLEYTDGNTYLS WFQQRPGQSPRRLIYKVSNRDSGVPDRFSGSGAGTDFTL RISRVEAEDVGVYYCMQGTHGRGISFGPGTKVDIK |
| 352 | 5627 | 1931 | RSSQGLEYTDGNTYLS |
| 352 | 5628 | 1932 | AGGTCTAGTCAAGGCCTCGAATACACTGATGGAAACA CCTACTTGAGT |
| 352 | 5629 | 1933 | KVSNRDS |
| 352 | 5630 | 1934 | AAGGTTTCTAATCGGGACTCT |
| 352 | 5631 | 1935 | MQGTHGRGIS |
| 352 | 5632 | 1936 | ATGCAAGGTACACACGGGCGGGGAATCTCT |
| 353 | 5633 | 1937 | CAGGTGCAGCTGGTGCAGTCTGGGGCTGAGGTGAAGA AGCCTGGGGCCTCAGTGAGGGTCTCCTGCAAGGCCTC TGGATACACCTTCACCGACTACTTTATGAACTGGGTGC GACAGGCCCCTGGAGGGGCCTTGAGTGGATGGGGTG GATCAATCCTCTCAGTGGAGTCACAAAATATGCACAG CAGTTTCAGGGCAGTGTCACCATGACCACTGACACGT CCATCACCACAGGCTACATGGAGCTGAGGAGCCTGAG AGTTGACGACACGGCCGTCTATTATTGTGCGAGCCAG TCTTCCCCCTTACACCCCGGGCGCCATGGGCGTCTGGG GCCAAGGGACCACGGTCACCGTCTCCTCA |
| 353 | 5634 | 1938 | QVQLVQSGAEVKKPGASVRVSCKASGYTFTDYFMNWV RQAPGGGLEWMGWINPLSGVTKYAQQFQGSVTMTTDT SITTGYMELRSLRVDDTAVYYCASQSSPYTPGAMGVWG QGTTVTVSS |

TABLE 6-continued

Informal Sequence Listing

| Antibody No. | Seq. Ref. No. | SEQ ID NO. | Sequence |
|---|---|---|---|
| 353 | 5635 | 1939 | YTFTDYFMN |
| 353 | 5636 | 1940 | TACACCTTCACCGACTACTTTATGAAC |
| 353 | 5637 | 1941 | WINPLSGVTKYAQQFQG |
| 353 | 5638 | 1942 | TGGATCAATCCTCTCAGTGGAGTCACAAAATATGCACAGCAGTTTCAGGGC |
| 353 | 5639 | 1943 | ASQSSPYTPGAMGV |
| 353 | 5640 | 1944 | GCGAGCCAGTCTTCCCCTTACACCCCGGGCGCCATGGGCGTC |
| 353 | 5641 | 1945 | GACATCCGGATGACCCAGTCTCCATCCTCCCTGTCTGCATCTGTAGGAGACAGAGTCACCATCACTTGCCGGACAAGTCAGAGCGTTAGCGGCTATTTAAGTTGGTATCAGCAGAAACCAGGGAAAGCCCCTAAGCTCCTGATCTATGCGGCATCCAATTTGTACAGTGGGGTCCCATCAAGGTTCAGTGGCAGTGGATCTGGGACAGATTTCACTCTCACCATCACCAGTCTGCAACCTGAAGATTTTGCAACTTACTTCTGTCAACTGAATTCCGGTGCCCTATTCACTTTCGGCCCTGGGACCAAGGTGGAAATCAAA |
| 353 | 5642 | 1946 | DIRMTQSPSSLSASVGDRVTITCRTSQSVSGYLSWYQQKPGKAPKLLIYAASNLYSGVPSRFSGSGSGTDFTLTITSLQPEDFATYFCQLNSGALFTFGPGTKVEIK |
| 353 | 5643 | 1947 | RTSQSVSGYLS |
| 353 | 5644 | 1948 | CGGACAAGTCAGAGCGTTAGCGGCTATTTAAGT |
| 353 | 5645 | 1949 | AASNLYS |
| 353 | 5646 | 1950 | GCGGCATCCAATTTGTACAGT |
| 353 | 5647 | 1951 | QLNSGALFT |
| 353 | 5648 | 1952 | CAACTGAATTCCGGTGCCCTATTCACT |
| 354 | 5649 | 1953 | GAGGTGCAGCTGGTGGAGTCTGGGGGAGGCTTGGTCAAGCCTGGAGAGTCCGTGAAACTCTCCTGCGCAGCGTCTGGATTCACCATCACTGACTCCTACATGGCCTGGATCCGCCAGTCTCCAGGGAAGGGGCTGGAGTGGCTTGCTTACATTAGTAGTACTAGTCTTTTCACAGACTACACAGACTCTGTGAAGGGCCGATTCATCATCACCAGAGACAATGCCGAGAACTCACTCTATCTGCAAATGACCAGCCTGACACCCGGCAGACACGGGTGTCTATTTCTGTGCGAGGGCCAAAACATCCTACTACTTCTACGCTCTGGACGTCTGGGGCCCAGGCACCCTGGTCACCGTCTCCTCA |
| 354 | 5650 | 1954 | EVQLVESGGGLVKPGESVKLSCAASGFTITDSYMAWIRQSPGKGLEWLAYISSTSLFTDYTDSVKGRFIITRDNAENSLYLQMTSLTPADTGVYFCARAKTSYYFYALDVWGPGTLVTVSS |
| 354 | 5651 | 1955 | FTITDSYMA |
| 354 | 5652 | 1956 | TTCACCATCACTGACTCCTACATGGCC |
| 354 | 5653 | 1957 | YISSTSLFTDYTDSVKG |
| 354 | 5654 | 1958 | TACATTAGTAGTACTAGTCTTTTCACAGACTACACAGACTCTGTGAAGGGC |
| 354 | 5655 | 1959 | ARAKTSYYFYALDV |
| 354 | 5656 | 1960 | GCGAGGGCCAAAACATCCTACTACTTCTACGCTCTGGACGTC |
| 354 | 5657 | 1961 | GAAACGACACTCACGCAGTCTCCAGGCACGCTGTCTTTGTCTCCGGGGGAAGAGCCACCCTCTCCTGCAGGGCCAGTCAGAGTGTTAACAACAACTATCTAGCCTGGTTCAGCACAAACCTGGCCAGGCTCCCAGACTCCTCATCTATAATGCATCCAACAGGGCCGCTGGCATCCCAGACAG |

TABLE 6-continued

Informal Sequence Listing

| Antibody No. | Seq. Ref. No. | SEQ ID NO. | Sequence |
|---|---|---|---|
| | | | GTTCAGTGGTAGTGGGTCTGGGACAGACTTCACTCTC<br>ACCATCAGCAAACTGGAGCCTGGAGATTCTGCAGTGT<br>ATTACTGTCAGCGATATGGGAACTCTTGGCCGTTCGG<br>CCAAGGGACCAAGGTGGAAATCAAA |
| 354 | 5658 | 1962 | ETTLTQSPGTLSLSPGERATLSCRASQSVNNNYLAWFQH<br>KPGQAPRLLIYNASNRAAGIPDRFSGSGSGTDFTLTISKL<br>EPGDSAVYYCQRYGNSWPFGQGTKVEIK |
| 354 | 5659 | 1963 | RASQSVNNNYLA |
| 354 | 5660 | 1964 | AGGGCCAGTCAGAGTGTTAACAACAACTATCTAGCC |
| 354 | 5661 | 1965 | NASNRAA |
| 354 | 5662 | 1966 | AATGCATCCAACAGGGCCGCT |
| 354 | 5663 | 1967 | QRYGNSWP |
| 354 | 5664 | 1968 | CAGCGATATGGGAACTCTTGGCCG |
| 355 | 5665 | 1969 | CAGGTCCAGCTGGTGCAGTCTGGGGGAGGCTTGGTAC<br>AGCCTGGGGGGTCCCTGAGACTCTCCTGTGCAGCCTC<br>TGGATTCACCTTTAGTCAGTCTCCCATGAGCTGGGTCC<br>GCCAGGCTCCTGGGAAGGGGCTGGAGTGGGTCTCCGG<br>TATTAGTACTGGAGGGACCAATACATACTACGCAGAC<br>TCCGTGAAGGGCCGCTTCACCATCTCCAGAGACAATT<br>CCAAGAACACGTTGTATCTGCAAATGACCAGCCTGAG<br>AGTCGGGGACACGGCCGTGTATTACTGTGCGAAAGAG<br>AGTTTAGACTTTGGTTCAGGGAGCTACAACTGGTTCG<br>ACACCTGGGGCCAGGGAACCCTGGTCACTGTCTCCTC<br>A |
| 355 | 5666 | 1970 | QVQLVQSGGGLVQPGGSLRLSCAASGFTFSQSPMSWVR<br>QAPGKGLEWVSGISTGGTNTYYADSVKGRFTISRDNSKN<br>TLYLQMTSLRVGDTAVYYCAKESLDFGSGSYNWFDTW<br>GQGTLVTVSS |
| 355 | 5667 | 1971 | FTFSQSPMS |
| 355 | 5668 | 1972 | TTCACCTTTAGTCAGTCTCCCATGAGC |
| 355 | 5669 | 1973 | GISTGGTNTYYADSVKG |
| 355 | 5670 | 1974 | GGTATTAGTACTGGAGGGACCAATACATACTACGCAG<br>ACTCCGTGAAGGGC |
| 355 | 5671 | 1975 | AKESLDFGSGSYNWFDT |
| 355 | 5672 | 1976 | GCGAAAGAGAGTTTAGACTTTGGTTCAGGGAGCTACA<br>ACTGGTTCGACACC |
| 355 | 5673 | 1977 | GAAATTGTATTGACGCAGTCTCCAGACTCCCTGGCTGT<br>GTCTCTGGGCGAGAGGGCCACCATCAACTGCAAGTCC<br>AGCCAGAGTGTTTTATACAGGTCCAACAATAAGAACT<br>ACTTAGCTTGGTACCAGCAGAGACCAGGACAGCCTCC<br>TAGGCTGCTCATTTCCTGGGCATCTACCCGGGAATCCG<br>GGGTCCCTGACCGATTCACTGGCAGCGGGTCTGGGAC<br>AGATTTCACTCTCACCATCAGCAGCCTGCAGGCTGAA<br>GATGTGGCAGTTTATTACTGTCACCAATATTATGATAC<br>CCACACTTTTGGCCAGGGGACCAAAGTGGATATCAAA |
| 355 | 5674 | 1978 | EIVLTQSPDSLAVSLGERATINCKSSQSVLYRSNNKNYLA<br>WYQQRPGQPPRLLISWASTRESGVPDRFTGSGSGTDFTL<br>TISSLQAEDVAVYYCHQYYDTHTFGQGTKVDIK |
| 355 | 5675 | 1979 | KSSQSVLYRSNNKNYLA |
| 355 | 5676 | 1980 | AAGTCCAGCCAGAGTGTTTTATACAGGTCCAACAATA<br>AGAACTACTTAGCT |
| 355 | 5677 | 1981 | WASTRES |
| 355 | 5678 | 1982 | TGGGCATCTACCCGGGAATCC |

TABLE 6-continued

Informal Sequence Listing

| Antibody No. | Seq. Ref. No. | SEQ ID NO. | Sequence |
|---|---|---|---|
| 355 | 5679 | 1983 | HQYYDTHT |
| 355 | 5680 | 1984 | CACCAATATTATGATACCCACACT |
| 356 | 5681 | 1985 | GAGGTGCAGCTGGTGGAGTCTGGGGGAGGCGTGGTCC<br>AGCCTGGGAGGTCCCTGAGACTCTCCTGTGTAGCCTCT<br>GGATTCAGCTTCAGTGCCTATGGCATGCACTGGGTTC<br>GCCAGGTTCCAACCAAGGGGCTGGAGTGGGTGGCTGT<br>TATATCATATGATGGAAGAGATATATACTATACAGAC<br>TCCGTGAAGGGCCGATTCACCATTTCCAGAGACAATT<br>CCAAGAACATGTTGTATCTGCAAATGAACAGCCTGAG<br>ACCTGAGGACAGGGCTGTCTATTACTGTGCGAGAGAT<br>CCGTCCCTCGGTTATAATAATCACTACTTTGACTATTG<br>GGGCCAGGGAACCCTGGTCACCGTCTCTTCA |
| 356 | 5682 | 1986 | EVQLVESGGGVVQPGRSLRLSCVASGFSFSAYGMHWVR<br>QVPTKGLEWVAVISYDGRDIYYTDSVKGRFTISRDNSKN<br>MLYLQMNSLRPEDRAVYYCARDPSLGYNNHYFDYWGQ<br>GTLVTVSS |
| 356 | 5683 | 1987 | FSFSAYGMH |
| 356 | 5684 | 1988 | TTCAGCTTCAGTGCCTATGGCATGCAC |
| 356 | 5685 | 1989 | VISYDGRDIYYTDSVKG |
| 356 | 5686 | 1990 | GTTATATCATATGATGGAAGAGATATATACTATACAG<br>ACTCCGTGAAGGGC |
| 356 | 5687 | 1991 | ARDPSLGYNNHYFDY |
| 356 | 5688 | 1992 | GCGAGAGATCCGTCCCTCGGTTATAATAATCACTACTT<br>TGACTAT |
| 356 | 5689 | 1993 | GAAATTGTGTTGACGCAGTCTCCAGCCACCCTGTCTTT<br>GTCTCCAGGGGAAACAGCCACCCTCTCCTGCAGGGCC<br>AGTCAGAGTGTTACCGGCAACTTAGCCTGGTACCAAC<br>AGAAACCTGGCCAGGCTCCCAGGCTCCTCATCTATGC<br>TGCATCCAACAGGGCCACTGGCATCCCAGCCAGGTTC<br>AGTGGCAGTGGGTCTGGGACAGACTTCACTCTCACCA<br>TCAGCAGCCTAGAGCCTGAAGATTTTGCAGTTTATTTC<br>TGTCAGCAGCGTAGCAACTGGCCTCCTATGTACAGTTT<br>TGGCCAGGGGACCAAGCTGGAGATCAAA |
| 356 | 5690 | 1994 | EIVLTQSPATLSLSPGETATLSCRASQSVTGNLAWYQQK<br>PGQAPRLLIYAASNRATGIPARFSGSGSGTDFTLTISSLEP<br>EDFAVYFCQQRSNWPPMYSFGQGTKLEIK |
| 356 | 5691 | 1995 | RASQSVTGNLA |
| 356 | 5692 | 1996 | AGGGCCAGTCAGAGTGTTACCGGCAACTTAGCC |
| 356 | 5693 | 1997 | AASNRAT |
| 356 | 5694 | 1998 | GCTGCATCCAACAGGGCCACT |
| 356 | 5695 | 1999 | QQRSNWPPMYS |
| 356 | 5696 | 2000 | CAGCAGCGTAGCAACTGGCCTCCTATGTACAGT |
| 357 | 5697 | 2001 | CAGGTCCAGCTTGTACAGTCTGGGGCTGAGGTGAAGA<br>GGCCTGGGTCCTCGGTGAAGGTCTCCTGCAAGGCCTC<br>TGGAGGCACCTTCAGAGGCTACCATATCAGCTGGGTG<br>CGACAGGCCCCTGGACAAGGGCTCGAGTGGATGGGA<br>GGGATCATCCATCTATTTGGGACAGTAAGCTACGCTC<br>CGAAGTTCCAGGGCAGAGTCACGATCACCGCGGACGC<br>ATCCACGGGCACAGCCCATATGGAGTTGAGCAGCCTG<br>ACATCTGACGACACGGCCATATACTATTGTGCGAGAG<br>ATGCTTACGAAGTCTGGACGGGTTCTTATCTCCCCCCT<br>TTTGACTACTGGGGCCAGGGAACCCTGGTCACCGTCT<br>CCTCA |

TABLE 6-continued

Informal Sequence Listing

| Antibody No. | Seq. Ref. No. | SEQ ID NO. | Sequence |
|---|---|---|---|
| 357 | 5698 | 2002 | QVQLVQSGAEVKRPGSSVKVSCKASGGTFRGYHISWVR QAPGQGLEWMGGIIHLFGTVSYAPKFQGRVTITADASTG TAHMELSSLTSDDTAIYYCARDAYEVWTGSYLPPFDYW GQGTLVTVSS |
| 357 | 5699 | 2003 | GTFRGYHIS |
| 357 | 5700 | 2004 | GGCACCTTCAGAGGCTACCATATCAGC |
| 357 | 5701 | 2005 | GIIHLFGTVSYAPKFQG |
| 357 | 5702 | 2006 | GGGATCATCCATCTATTTGGGACAGTAAGCTACGCTC CGAAGTTCCAGGGC |
| 357 | 5703 | 2007 | ARDAYEVWTGSYLPPFDY |
| 357 | 5704 | 2008 | GCGAGAGATGCTTACGAAGTCTGGACGGGTTCTTATC TCCCCCCTTTTGACTAC |
| 357 | 5705 | 2009 | GATATTGTGATGACTCAGACTCCAGGCACCCTGTCTTT GTCTCCCGGGGAAAGAGTCACCCTCTCCTGCAGGGCC AGTCAGACTGTTACAAGCAGCTACTTAGCCTGGTACC AGCAGAAACCTGGCCAGGCTCCCAGACTCCTCATCTA TGGTGCATTCACCAGGGCCACTGGCATCCCAGACAGG TTCAGTGGTAGTGGGTCTGGGACAGACTTCACTCTCA CCATCAGCAGACTGGAGCCTGAAGATTTTGCAGTATA TTACTGTCAGCAGTATGGTAGCTCATTCCTCACTTTCG GCGGAGGGACCAAGCTGGAGATCAAA |
| 357 | 5706 | 2010 | DIVMTQTPGTLSLSPGERVTLSCRASQTVTSSYLAWYQQ KPGQAPRLLIYGAFTRATGIPDRFSGSGSGTDFTLTISRLE PEDFAVYYCQQYGSSFLTFGGGTKLEIK |
| 357 | 5707 | 2011 | RASQTVTSSYLA |
| 357 | 5708 | 2012 | AGGGCCAGTCAGACTGTTACAAGCAGCTACTTAGCC |
| 357 | 5709 | 2013 | GAFTRAT |
| 357 | 5710 | 2014 | GGTGCATTCACCAGGGCCACT |
| 357 | 5711 | 2015 | QQYGSSFLT |
| 357 | 5712 | 2016 | CAGCAGTATGGTAGCTCATTCCTCACT |
| 358 | 5713 | 2017 | GAGGTGCAGCTGGTGGAGTCTGGGGGAGGCCTGGTCA AGCCTGGGGGGTCCCTGAGACTCTCCTGTGCAGCCTC TGGATTCACCTTCAGTAGCTATAGCATGAACTGGGTC CGCCAGGCTCCAGGGAAGGGGCTGGAGTGGGTCTCAT CCATTAGTAGTAGTAGTAGTTACATATACTACGCAGA CTCAGTGAAGGGCCGATTCACCATCTCCAGAGACAAC GCCAAGAACTCACTGTATCTGCAAATGAACAGCCTGA GAGCCGAGGACACGGCTGTGTATTACTGTGCGAGAGA TGTGCAATATAGTGGCTACGATTCTGGGTACTACTTTG ACTACTGGGGCCAGGGAACCCTGGTCACTGTCTCCTC A |
| 358 | 5714 | 2018 | EVQLVESGGGLVKPGGSLRLSCAASGFTFSSYSMNWVR QAPGKGLEWVSSISSSSSYIYYADSVKGRFTISRDNAKNS LYLQMNSLRAEDTAVYYCARDVQYSGYDSGYYFDYW GQGTLVTVSS |
| 358 | 5715 | 2019 | FTFSSYSMN |
| 358 | 5716 | 2020 | TTCACCTTCAGTAGCTATAGCATGAAC |
| 358 | 5717 | 2021 | SISSSSSYIYYADSVKG |
| 358 | 5718 | 2022 | TCCATTAGTAGTAGTAGTAGTTACATATACTACGCAG ACTCAGTGAAGGGC |
| 358 | 5719 | 2023 | ARDVQYSGYDSGYYFDY |
| 358 | 5720 | 2024 | GCGAGAGATGTGCAATATAGTGGCTACGATTCTGGGT ACTACTTTGACTAC |

TABLE 6-continued

Informal Sequence Listing

| Antibody No. | Seq. Ref. No. | SEQ ID NO. | Sequence |
|---|---|---|---|
| 358 | 5721 | 2025 | CAGCCTGTGCTGACTCAGCCACCCTCAGTGTCTGGGG<br>CCCCAGGACAGAGGGTCACCATCTCCTGCACTGGGAG<br>CAGCTCCAACATCGGGGCAGGTTATGATGTACACTGG<br>TACCAGCAGCTTCCAGGAACAGCCCCCAAACTCCTCA<br>TCTATGGTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCAGCCTGAGTGCCC<br>TTTATGTCTTCGGAACTGGGACCAAGGTGACCGTCCT<br>A |
| 358 | 5722 | 2026 | QPVLTQPPSVSGAPGQRVTISCTGSSSNIGAGYDVHWYQ<br>QLPGTAPKLLIYGNSNRPSGVPDRFSGSKSGTSASLAITG<br>LQAEDEADYYCQSYDSSLSALYVFGTGTKVTVL |
| 358 | 5723 | 2027 | TGSSSNIGAGYDVH |
| 358 | 5724 | 2028 | ACTGGGAGCAGCTCCAACATCGGGGCAGGTTATGATG<br>TACAC |
| 358 | 5725 | 2029 | GNSNRPS |
| 358 | 5726 | 2030 | GGTAACAGCAATCGGCCCTCA |
| 358 | 5727 | 2031 | QSYDSSLSALYV |
| 358 | 5728 | 2032 | CAGTCCTATGACAGCAGCCTGAGTGCCCTTTATGTC |
| 359 | 5729 | 2033 | GAGGTGCAGCTGGTGGAGTCTGGGGGAGGCGTGGTCC<br>AGCCGGGGGGGTCCCTGAGACTCTCCTGTGCAGGCTC<br>TGGATTCGCCTTCGGTAGCTTCGCGATGCACTGGGTCC<br>GTCAGGCTCCAGGCAAGGGGCTGGAGTGGGTGGCTGT<br>TATTTCATTTGACGGAAAGAATACAAAATATGCTGAC<br>TCCGTGAAGGGCCGATTCACCACCTCCAGAGACAATT<br>CCAGGAACACGCTCTATCTCCAAATGGACAGCCTGAG<br>AGGTGACGACACGGCTATATATTACTGCGCGACAATT<br>AGGGGAATTGTGGCTGGCCTTTGTGACAACTGGGGCC<br>AGGGAACCCTGGTCACCGTCTCCTCA |
| 359 | 5730 | 2034 | EVQLVESGGGVVQPGGSLRLSCAGSGFAFGSFAMHWVR<br>QAPGKGLEWVAVISFDGKNTKYADSVKGRFTTSRDNSR<br>NTLYLQMDSLRGDDTAIYYCATIRGIVAGLCDNWGQGT<br>LVTVSS |
| 359 | 5731 | 2035 | FAFGSFAMH |
| 359 | 5732 | 2036 | TTCGCCTTCGGTAGCTTCGCGATGCAC |
| 359 | 5733 | 2037 | VISFDGKNTKYADSVKG |
| 359 | 5734 | 2038 | GTTATTTCATTTGACGGAAAGAATACAAAATATGCTG<br>ACTCCGTGAAGGGC |
| 359 | 5735 | 2039 | ATIRGIVAGLCDN |
| 359 | 5736 | 2040 | GCGACAATTAGGGGAATTGTGGCTGGCCTTTGTGACA<br>AC |
| 359 | 5737 | 2041 | CAGCCTGTGCTGACTCAATCATCGTCTGACTCTGCTTC<br>CCTGGGAGCCTCGGTCAAGCTCACCTGTACTCTGAGC<br>AGTGGCCACAGAAACTACATCATCGCATGGCATCAAC<br>AACAACCAGGGAAGGCCCCTCGGTTCCTGATGAAGGT<br>TGAAGGTAGTGGAAGCTTCACCATGGGGAGCGGAGTT<br>CCTGATCGCTTCTCGGGCTCCAGCTCTGGGGCTGACCG<br>CTACCTCACCATCTCCAACCTCCAGTCTGAGGATGAG<br>GCTGATTATTACTGTGAGGCCTGGGACTTTAACACGG<br>GGGGGGGTCTTCGGCGGAGGCACCCAGCTGACCGTCCT<br>C |
| 359 | 5738 | 2042 | QPVLTQSSSDSASLGASVKLTCTLSSGHRNYIIAWHQQQ<br>PGKAPRFLMKVEGSGSFTMGSGVPDRFSGSSSGADRYLT<br>ISNLQSEDEADYYCEAWDFNTGGVFGGGTQLTVL |
| 359 | 5739 | 2043 | TLSSGHRNYIIA |

TABLE 6-continued

Informal Sequence Listing

| Antibody No. | Seq. Ref. No. | SEQ ID NO. | Sequence |
|---|---|---|---|
| 359 | 5740 | 2044 | ACTCTGAGCAGTGGCCACAGAAACTACATCATCGCA |
| 359 | 5741 | 2045 | VEGSGSFTMGS |
| 359 | 5742 | 2046 | GTTGAAGGTAGTGGAAGCTTCACCATGGGGAGC |
| 359 | 5743 | 2047 | EAWDFNTGGV |
| 359 | 5744 | 2048 | GAGGCCTGGGACTTTAACACGGGGGGGGTC |
| 360 | 5745 | 2049 | GAGGTGCAGCTGGTGGAGTCGGGCCCAGGACTGGTGA AGCCTTCGGGGACCCTGTCCCTCACCTGCGCTGTCTCT GGTGACTCCATCGTCGGTAGTGACTGGTGGAGTTGGA TCCGCCAGCCCCCCGGGAAGGGGCTGGAGTGGATTGG AGATATCTATCATGGTGGGACCACCAGCTACAACCCG TCCCTTAAGAGTCGAGTCACCATGTCAGTAGACAAGT CCAAGAACCAATTCTCCCTGAAGCTGACCTCTGTCAC CGCCGCGGACACAGCCGTGTATTACTGTGCGAGACTC TCGGGAAATTGTAGTGGTGGTAGCTGTTACTCGCCCTT TGACCACTGGGGCCAGGGAACCCTGGTCACCGTCTCT TCA |
| 360 | 5746 | 2050 | EVQLVESGPGLVKPSGTLSLTCAVSGDSIVGSDWWSWIR QPPGKGLEWIGDIYHGGTTSYNPSLKSRVTMSVDKSKN QFSLKLTSVTAADTAVYYCARLSGNCSGGSCYSPFDHW GQGTLVTVSS |
| 360 | 5747 | 2051 | DSIVGSDWWS |
| 360 | 5748 | 2052 | GACTCCATCGTCGGTAGTGACTGGTGGAGT |
| 360 | 5749 | 2053 | DIYHGGTTSYNPSLKS |
| 360 | 5750 | 2054 | GATATCTATCATGGTGGGACCACCAGCTACAACCCGT CCCTTAAGAGT |
| 360 | 5751 | 2055 | ARLSGNCSGGSCYSPFDH |
| 360 | 5752 | 2056 | GCGAGACTCTCGGGAAATTGTAGTGGTGGTAGCTGTT ACTCGCCCTTTGACCAC |
| 360 | 5753 | 2057 | GACATCCAGATGACCCAGTCTCCATCCTCCTTGTCTGC ATCTGTGGGAGACAGAGTCACCATCACTTGCCGGGCA AGTCAGACCATTAATGGTTATTTAAATTGGTATCAAC AAAGACCAGGGAAAGCCCCTAAACTCCTGATCTCTGC TGCATCCAGTTTGCAGAGTGGGGTCCCATCAAGGTTC CGTGGCAGTGGATATGGGACAGATTTCACTCTCACCA TCAGCAGTCTGCAACCTGAAGATTTTGCAACTTATTTC TGTCAACAGAGTTACAATACTGTGTACACTTTTGGGC AGGGGACCAAAGTGGATATCAAA |
| 360 | 5754 | 2058 | DIQMTQSPSSLSASVGDRVTITCRASQTINGYLNWYQQR PGKAPKLLISAASSLQSGVPSRFRGSGYGTDFTLTISSLQP EDFATYFCQQSYNTVYTFGQGTKVDIK |
| 360 | 5755 | 2059 | RASQTINGYLN |
| 360 | 5756 | 2060 | CGGGCAAGTCAGACCATTAATGGTTATTTAAAT |
| 360 | 5757 | 2061 | AASSLQS |
| 360 | 5758 | 2062 | GCTGCATCCAGTTTGCAGAGT |
| 360 | 5759 | 2063 | QQSYNTVYT |
| 360 | 5760 | 2064 | CAACAGAGTTACAATACTGTGTACACT |
| 361 | 5761 | 2065 | CAGGTGCAGCTGGTGCAGTCTGGAGCAGAGGTGAAA AAGCCCGGGGAGTCTCTGAAGATCTCCTGTAAGGGTT CTGGATACAGCTTTAGCAGCTACTGGATCGGCTGGGT GCGCCAGATGCCCGGGAAAGGCCTGGAGTGGATGGG GATCATCTATCCTGGTGACTCTGATACCAGATACAGC CCGTCGCTCCAAGGCCAGGTCACCATCTCAGGCGACA AGTCCATCAGTACCGCCTTCCTGCAGTGGAGCAGCCT GAAGGCCTCGGACACCGCCATGTATTACTGTGCGAGA |

TABLE 6-continued

Informal Sequence Listing

| Antibody No. | Seq. Ref. No. | SEQ ID NO. | Sequence |
|---|---|---|---|
| | | | CCCATGACTACCCAAGAAGGTTTTGATTTGTGGGGCC<br>AAGGGACAATGGTCACCGTCTCTTCA |
| 361 | 5762 | 2066 | QVQLVQSGAEVKKPGESLKISCKGSGYSFSSYWIGWVR<br>QMPGKGLEWMGIIYPGDSDTRYSPSLQGQVTISGDKSIST<br>AFLQWSSLKASDTAMYYCARPMTTQEGFDLWGQGTMV<br>TVSS |
| 361 | 5763 | 2067 | YSFSSYWIG |
| 361 | 5764 | 2068 | TACAGCTTTAGCAGCTACTGGATCGGC |
| 361 | 5765 | 2069 | IIYPGDSDTRYSPSLQG |
| 361 | 5766 | 2070 | ATCATCTATCCTGGTGACTCTGATACCAGATACAGCCC<br>GTCGCTCCAAGGC |
| 361 | 5767 | 2071 | ARPMTTQEGFDL |
| 361 | 5768 | 2072 | GCGAGACCCATGACTACCCAAGAAGGTTTTGATTTG |
| 361 | 5769 | 2073 | GACATCCGGTTGACCCAGTCTCCATCTTCTGTGTCTGC<br>ATCTGTAGGAGACAGAGTCACCATCACTTGTCGGGCG<br>AGTCAGGGTATTAGCGACTGGTTAGCCTGGTATCAGC<br>AGAAACCAGGGAAAGCCCCTAAACTCCTGATCTATGC<br>TGCATCCAGTTTGCAAAGTGGGGTCCCATCAAGGTTC<br>AGCGGCAGTGGATCTGGGACAGATTTCACTCTCACTA<br>TCAGCAGCCTGCAGCCTGAAGATTTTGCAACTTACTAT<br>TGTCAACAGACTAACAGTTTCCTCCCGCTCACTTTCGG<br>CGGAGGGACCAAAGTGGATATCAAA |
| 361 | 5770 | 2074 | DIRLTQSPSSVSASVGDRVTITCRASQGISDWLAWYQQK<br>PGKAPKLLIYAASSLQSGVPSRFSGSGSGTDFTLTISSLQP<br>EDFATYYCQQTNSFLPLTFGGGTKVDIK |
| 361 | 5771 | 2075 | RASQGISDWLA |
| 361 | 5772 | 2076 | CGGGCGAGTCAGGGTATTAGCGACTGGTTAGCC |
| 361 | 5773 | 2077 | AASSLQS |
| 361 | 5774 | 2078 | GCTGCATCCAGTTTGCAAAGT |
| 361 | 5775 | 2079 | QQTNSFLPLT |
| 361 | 5776 | 2080 | CAACAGACTAACAGTTTCCTCCCGCTCACT |
| 362 | 5777 | 2081 | GAGGTGCAGCTGGTGGAGTCGGGCCCCCGACTGGTGA<br>AGCCTTCACAGACCCTGTCCCTCACCTGCACCGTCTAT<br>GGTGGCTCCATCAGCGGTGGTCAAAACTACTACAGTT<br>GGGTCCGCCAGCCCCCAGGGAAGGGCCTGGAGTGGAT<br>TGGGTACATCTTTTCCAGTGGGACCACCTACTACAAG<br>CCGTCCCTCAAGAGTCGAATTTCCATTTCATTTGACAC<br>GTCCAAGAACCAGTTCTCCCTGAACCTGGCCTCTGTG<br>ACGGCCGCAGACACGGCCGTATATTTCTGTGCCAGAT<br>CCGCTGACATTGATATCGTTTGGGGGAGTTCTCTCTAC<br>ATGCCTCTCTGGGGCCAGGGAACCCTGGTCACCGTCT<br>CCTCA |
| 362 | 5778 | 2082 | EVQLVESGPRLVKPSQTLSLTCTVYGGSISGGQNYYSWV<br>RQPPGKGLEWIGYIFSSGTTYYKPSLKSRISISFDTSKNQF<br>SLNLASVTAADTAVYFCARSADIDIVWGSSLYMPLWGQ<br>GTLVTVSS |
| 362 | 5779 | 2083 | GSISGGQNYYS |
| 362 | 5780 | 2084 | GGCTCCATCAGCGGTGGTCAAAACTACTACAGT |
| 362 | 5781 | 2085 | YIFSSGTTYYKPSLKS |
| 362 | 5782 | 2086 | TACATCTTTTCCAGTGGGACCACCTACTACAAGCCGTC<br>CCTCAAGAGT |
| 362 | 5783 | 2087 | ARSADIDIVWGSSLYMPL |

TABLE 6-continued

Informal Sequence Listing

| Antibody No. | Seq. Ref. No. | SEQ ID NO. | Sequence |
|---|---|---|---|
| 362 | 5784 | 2088 | GCCAGATCCGCTGACATTGATATCGTTTGGGGGAGTT<br>CTCTCTACATGCCTCTC |
| 362 | 5785 | 2089 | GAAATTGTGTTGACGCAGTCTCCAGGCACCCTGTCTTT<br>GTCTCCAGGACAAAGAGCCACCCTCTCCTGCAGGGCC<br>ACTCACATTGTCAGTAACAGCTACTTAGCCTGGTACC<br>AGCAGAAACCTGGCCAGGCTCCCAGGCTCCTCATCCA<br>TGGTGTTTCCATCAGGGCCACTGGCATCCCAGACAGG<br>TTCTCTGGCAGTGGGTCTGGGACAGACTTCACTCTCAC<br>CATCAGCAGACTGGAGCCTGAAGATTTTGCAGTGTAT<br>TTCTGTCAGCAGTATGGTACCTCACCGTGGACGTTCGG<br>CCAAGGGACCAAGCTGGAGATCAAA |
| 362 | 5786 | 2090 | EIVLTQSPGTLSLSPGQRATLSCRATHIVSNSYLAWYQQ<br>KPGQAPRLLIHGVSIRATGIPDRFSGSGSGTDFTLTISRLE<br>PEDFAVYFCQQYGTSPWTFGQGTKLEIK |
| 362 | 5787 | 2091 | RATHIVSNSYLA |
| 362 | 5788 | 2092 | AGGGCCACTCACATTGTCAGTAACAGCTACTTAGCC |
| 362 | 5789 | 2093 | GVSIRAT |
| 362 | 5790 | 2094 | GGTGTTTCCATCAGGGCCACT |
| 362 | 5791 | 2095 | QQYGTSPWT |
| 362 | 5792 | 2096 | CAGCAGTATGGTACCTCACCGTGGACG |
| 363 | 5793 | 2097 | CAGGTGCAGCTGGTGGAGTCTGGGGGAGGCCTGGTCA<br>AGCCGGGGGGGTCCCTGAGACTCTCCTGTGTAGCCTC<br>TGGATTTACCTTCAGCAGTTATGCCATGAATTGGGTCC<br>GCCAGGCTCCAGGGAAGGGGCTGGACTGGGTCTCCTC<br>TATCAGTGCTGGTAGCAATTTCATAGACGACGCAGAC<br>TCAGTGAAGGGCCGCTTCACCATCTCCAGAGACAACG<br>CCAGGAACTCACTGTTTCTGCAGATGAACAGCCTGAG<br>AGCCGAGGACACGGCTGTGTATTACTGTGCGAGAATT<br>GGGTACAGTAGCGCGCACCACTACCAGTACTACATGG<br>ACGTCTGGGGCACGGGGACCACGGTCACCGTCTCCTC<br>A |
| 363 | 5794 | 2098 | QVQLVESGGGLVKPGGSLRLSCVASGFTFSSYAMNWVR<br>QAPGKGLDWVSSISAGSNFIDDADSVKGRFTISRDNARN<br>SLFLQMNSLRAEDTAVYYCARIGYSSAHHYQYYMDVW<br>GTGTTVTVSS |
| 363 | 5795 | 2099 | FTFSSYAMN |
| 363 | 5796 | 2100 | TTTACCTTCAGCAGTTATGCCATGAAT |
| 363 | 5797 | 2101 | SISAGSNFIDDADSVKG |
| 363 | 5798 | 2102 | TCTATCAGTGCTGGTAGCAATTTCATAGACGACGCAG<br>ACTCAGTGAAGGGC |
| 363 | 5799 | 2103 | ARIGYSSAHHYQYYMDV |
| 363 | 5800 | 2104 | GCGAGAATTGGGTACAGTAGCGCGCACCACTACCAGT<br>ACTACATGGACGTC |
| 363 | 5801 | 2105 | CAGTCTGTCCTGACGCAGCCGCCCTCAGTGTCTGGGG<br>CCCCAGGGCAGAGGGTCACCATCTCCTGCACTGGCAG<br>CAGCTCCAACATCGGGGCAGGTTATGATGTCCACTGG<br>TACCAGGATCTTCCAGGAACTGCCCCCAAACTCCTCA<br>TCTATGGTAACACCAATCGGCCCTCAGGGGTCCCTGA<br>CCGATTCTCTGGCTCCAAGTCTGGCGCCTCAGCCTCCC<br>TGGTCATCACTGGGCTCCAGGCTGAGGATGAGGCTGA<br>TTATTACTGCCAGTCCTATGACAAGAGCCTGAGTGGT<br>GGGTATGTCTTCGGAACTGGGACCAAGGTCACCGTCC<br>TA |
| 363 | 5802 | 2106 | QSVLTQPPSVSGAPGQRVTISCTGSSSNIGAGYDVHWYQ<br>DLPGTAPKLLIYGNTNRPSGVPDRFSGSKSGASASLVITG<br>LQAEDEADYYCQSYDKSLSGGYVFGTGTKVTVL |

TABLE 6-continued

Informal Sequence Listing

| Antibody No. | Seq. Ref. No. | SEQ ID NO. | Sequence |
|---|---|---|---|
| 363 | 5803 | 2107 | TGSSSNIGAGYDVH |
| 363 | 5804 | 2108 | ACTGGCAGCAGCTCCAACATCGGGGCAGGTTATGATGTCCAC |
| 363 | 5805 | 2109 | GNTNRPS |
| 363 | 5806 | 2110 | GGTAACACCAATCGGCCCTCA |
| 363 | 5807 | 2111 | QSYDKSLSGGYV |
| 363 | 5808 | 2112 | CAGTCCTATGACAAGAGCCTGAGTGGTGGGTATGTC |
| 364 | 5809 | 2113 | CAGGTCCAGCTGGTGCAGTCTGGGGCTGAGGTGAAGAAGCCTGGGGCCTCAGTGAGGGTCACCTGCAAGGCCTCTGGATACACCTTCACCGACTACTTTATGAACTGGGTGCGACAGGCCCCTGGAGGGGGCCTTGAGTGGATGGGGTGGATCAATCCTCTCAGTGGAGTCACAAAATATGCACAGCAGTTTCAGGGCAGTGTCACCATGACCACTGACACGTCCATCACCACAGGCTACATGGAGCTGAGGAGCCTGAGAGTTGACGACACGGCCGTCTATTATTGTGCGAGCCAGTCTTCCCCTTACACCCCGGGCGCCATGGGCGTCTGGGGCCAAGGGACCACGGTCACCGTCTCTTCA |
| 364 | 5810 | 2114 | QVQLVQSGAEVKKPGASVRVTCKASGYTFTDYFMNWVRQAPGGGLEWMGWINPLSGVTKYAQQFQGSVTMTTDTSITTGYMELRSLRVDDTAVYYCASQSSPYTPGAMGVWGQGTTVTVSS |
| 364 | 5811 | 2115 | YTFTDYFMN |
| 364 | 5812 | 2116 | TACACCTTCACCGACTACTTTATGAAC |
| 364 | 5813 | 2117 | WINPLSGVTKYAQQFQG |
| 364 | 5814 | 2118 | TGGATCAATCCTCTCAGTGGAGTCACAAAATATGCACAGCAGTTTCAGGGC |
| 364 | 5815 | 2119 | ASQSSPYTPGAMGV |
| 364 | 5816 | 2120 | GCGAGCCAGTCTTCCCCTTACACCCCGGGCGCCATGGGCGTC |
| 364 | 5817 | 2121 | TCCTATGAGCTGATACAGCTACCCTCGGTGTCAGTGTCCCCAGGACAGACGGCCAGGATCACCTGCTCTGGAGATGCATTGCCAAAGCAATATGCTTATTGGTACCAGCAGAAGCCAGGCCAGGCCCCTGTGCTGGTGATATATAAGACAGTGAGAGGCCCTCAGGGATCCCTGAGCGATTCTCTGGCTCCAGCTCAGGGACAACAGTCACGTTGACCATCAGTGGAGTCCAGGCAGAAGACGAGGCTGACTATTACTGTCAATCAGCAGACAGCAGTGGTACTTATCCGGTGGTGTTCGGCGGAGGGACCAAGCTCACCGTCCTA |
| 364 | 5818 | 2122 | SYELIQLPSVSVSPGQTARITCSGDALPKQYAYWYQQKPGQAPVLVIYKDSERPSGIPERFSGSSSGTTVTLTISGVQAEDEADYYCQSADSSGTYPVVFGGGTKLTVL |
| 364 | 5819 | 2123 | SGDALPKQYAY |
| 364 | 5820 | 2124 | TCTGGAGATGCATTGCCAAAGCAATATGCTTAT |
| 364 | 5821 | 2125 | KDSERPS |
| 364 | 5822 | 2126 | AAAGACAGTGAGAGGCCCTCA |
| 364 | 5823 | 2127 | QSADSSGTYPVV |
| 364 | 5824 | 2128 | CAATCAGCAGACAGCAGTGGTACTTATCCGGTGGTG |
| 365 (ADI-31382) | 5825 | 2145 | GAGGTGCAGCTGGTGGAGTCTGGGGGAGGCCTGGTCAAGCCTGGGGGGCCCTGAGACTCTCCTGTGCAGCCTCTGGATTCAGCTTCAGGAGCTATAGCATGAACTGGGTCCGCCAGGCTCCAGGGAAGGGGCTGGAGTGGGTCTCATCCATTAGTAGTAGTAGTAATTACATAAACTACGCAGACTCAGTGAAGGGCCGATTCAGCATCTCCAGAGACAAC |

TABLE 6-continued

Informal Sequence Listing

| Antibody No. | Seq. Ref. No. | SEQ ID NO. | Sequence |
|---|---|---|---|
| | | | GCCAAGAACTCACTGTATCTGCAAATGAACAGCCTGA<br>GAGCCGAGGACACGGCTGTCTATTACTGTGCGAGAGA<br>TTTGTTACCCGTCGAGCGGGGTCCCGCTTTTGATATCT<br>GGGGCCAAGGGACAATGGTCACCGTCTCTTCA |
| | 5826 | 2146 | EVQLVESGGGLVKPGGALRLSCAASGFSFRSYSMNWVR<br>QAPGKGLEWVSSISSSSNYINYADSVKGRFSISRDNAKNS<br>LYLQMNSLRAEDTAVYYCARDLLPVERGPAFDIWGQGT<br>MVTVSS |
| | 5827 | 2147 | FSFRSYSMN |
| | 5828 | 2148 | SISSSSNYINYADSVKG |
| | 5829 | 2149 | ARDLLPVERGPAFDI |
| | 5830 | 2150 | TCCTACGAGCTGACACAGCCACCCTCAGTGTCTGGGG<br>CCCCAGGGCAGAGGGTCACTATCTCCTGCACTGGGAG<br>CAGCTCCAACATCGGGAGGGGTTATGATGTACACTGG<br>TTCCAGCAGCTTCCAGGAGCAGCCCCCAAACTCCTCA<br>TCTATGCTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCAGACTGGGTGGTT<br>CGGTATTCGGCGGAGGGACCAAGGTGACCGTCCTA |
| | 5831 | 2151 | SYELTQPPSVSGAPGQRVTISCTGSSSNIGRGYDVHWFQ<br>QLPGAAPKLLIYANSNRPSGVPDRFSGSKSGTSASLAITG<br>LQAEDEADYYCQSYDSRLGGSVFGGGTKVTVL |
| | 5832 | 2152 | TGSSSNIGRGYDVH |
| | 5833 | 2153 | ANSNRPS |
| | 5834 | 2154 | QSYDSRLGGSV |
| 366 (ADI-31383) | 5835 | 2155 | GAGGTGCAGCTGGTGGAGTCTGGGGGAGGCCTGGTCA<br>AGCCTGGGGGGCCCTGAGACTCTCCTGTGCAGCCTC<br>TGGATTCAGCTTCAGGAGCTATAGCATGAACTGGGTC<br>CGCCAGGCTCCAGGGAAGGGGCTGGAGTGGGTCTCAT<br>CCATTAGTAGTAGTAGTAATTACATAAACTACGCAGA<br>CTCAGTGAAGGGCCGATTCAGCATCTCCAGAGACAAC<br>GCCAAGAACTCACTGTATCTGCAAATGAACAGCCTGA<br>GAGCCGAGGACACGGCTGTCTATTACTGTGCGAGAGA<br>TTTGTTACCCGTCGAGCGGGGTCCCGCTTTTGATATCT<br>GGGGCCAAGGGACAATGGTCACCGTCTCTTCA |
| | 5836 | 2156 | EVQLVESGGGLVKPGGALRLSCAASGFSFRSYSMNWVR<br>QAPGKGLEWVSSISSSSNYINYADSVKGRFSISRDNAKNS<br>LYLQMNSLRAEDTAVYYCARDLLPVERGPAFDIWGQGT<br>MVTVSS |
| | 5837 | 2157 | FSFRSYSMN |
| | 5838 | 2158 | SISSSSNYINYADSVKG |
| | 5839 | 2159 | ARDLLPVERGPAFDI |
| | 5840 | 2160 | TCCTATGAGCTGACACAGCCACCCTCAGTGTCTGGGG<br>CCCCAGGGCAGAGGGTCACCATCTCCTGCACTGGGAG<br>CAGCTCCAACATCGGGGCAGGTTATGATGTACACTGG<br>TTCCAGCAGCTTCCAGGAGCAGCCCCCAAACTCCTCA<br>TCTATCGTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCAGACTGGGTGGTT<br>CGAATTTCGGCGGAGGGACCAAGGTGACCGTCCTA |
| | 5841 | 2161 | SYELTQPPSVSGAPGQRVTISCTGSSSNIGAGYDVHWFQ<br>QLPGAAPKLLIYRNSNRPSGVPDRFSGSKSGTSASLAITG<br>LQAEDEADYYCQSYDSRLGGSNFGGGTKVTVL |
| | 5842 | 2162 | TGSSSNIGAGYDVH |

TABLE 6-continued

Informal Sequence Listing

| Antibody No. | Seq. Ref. No. | SEQ ID NO. | Sequence |
|---|---|---|---|
| | 5843 | 2163 | RNSNRPS |
| | 5844 | 2164 | QSYDSRLGGSN |
| 367 (ADI-31384) | 5845 | 2165 | GAGGTGCAGCTGGTGGAGTCTGGGGGAGGCCTGGTCA<br>AGCCTGGGGGGCCCTGAGACTCTCCTGTGCAGCCTC<br>TGGATTCAGCTTCAGGAGCTATAGCATGAACTGGGTC<br>CGCCAGGCTCCAGGGAAGGGGCTGGAGTGGGTCTCAT<br>CCATTAGTGCTAGTAGTAATTACATAAACTACGCAGA<br>CTCAGTGAAGGGCCGATTCAGCATCTCCAGAGACAAC<br>GCCAAGAACTCACTGTATCTGCAAATGAACAGCCTGA<br>GAGCCGAGGACACGGCTGTCTATTACTGTGCGAGAGA<br>TTTGTTACCCGTCGAGCGGGGTCCCGCTTTTGATATCT<br>GGGGCCAAGGGACAATGGTCACCGTCTCTTCA |
| | 5846 | 2166 | EVQLVESGGGLVKPGGALRLSCAASGFSFRSYSMNWVR<br>QAPGKGLEWVSSISASSNYINYADSVKGRFSISRDNAKN<br>SLYLQMNSLRAEDTAVYYCARDLLPVERGPAFDIWGQG<br>TMVTVSS |
| | 5847 | 2167 | FSFRSYSMN |
| | 5848 | 2168 | SISASSNYINYADSVKG |
| | 5849 | 2169 | ARDLLPVERGPAFDI |
| | 5850 | 2170 | TCCTATGAGCTGACACAGCCACCCTCAGTGTCTGGGG<br>CCCCAGGGCAGAGGGTCACCATCTCCTGCACTGGGAG<br>CAGCTCCAACATCGGGGCAGGTTATGATGTACACTGG<br>TTCCAGCAGCTTCAGGAGCAGCCCCCAAACTCCTCA<br>TCTATGCTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCAGACTGGGTGGTT<br>CGGTATTCGGCGGAGGGACCAAGGTGACCGTCCTA |
| | 5851 | 2171 | SYELTQPPSVSGAPGQRVTISCTGSSSNIGAGYDVHWFQ<br>QLPGAAPKLLIYANSNRPSGVPDRFSGSKSGTSASLAITG<br>LQAEDEADYYCQSYDSRLGGSVFGGGTKVTVL |
| | 5852 | 2172 | TGSSSNIGAGYDVH |
| | 5853 | 2173 | ANSNRPS |
| | 5854 | 2174 | QSYDSRLGGSV |
| 368 (ADI-31385) | 5855 | 2175 | GAGGTGCAGCTGGTGGAGTCTGGGGGAGGCCTGGTCA<br>AGCCTGGGGGGCCCTGAGACTCTCCTGTGCAGCCTC<br>TGGATTCAGCTTCAGGAGCTATAGCATGAACTGGGTC<br>CGCCAGGCTCCAGGGAAGGGGCTGGAGTGGGTCTCAT<br>CCATTAGTAGTAGTAGTACTTACATAAACTACGCAGA<br>CTCAGTGAAGGGCCGATTCAGCATCTCCAGAGACAAC<br>GCCAAGAACTCACTGTATCTGCAAATGAACAGCCTGA<br>GAGCCGAGGACACGGCTGTCTATTACTGTGCGAGAGA<br>TTTGAGTCCCGTCGAGCGGGGTCCCGCTTTTGATATCT<br>GGGGCCAAGGGACAATGGTCACCGTCTCTTCA |
| | 5856 | 2176 | EVQLVESGGGLVKPGGALRLSCAASGFSFRSYSMNWVR<br>QAPGKGLEWVSSISSSSTYINYADSVKGRFSISRDNAKNS<br>LYLQMNSLRAEDTAVYYCARDLSPVERGPAFDIWGQGT<br>MVTVSS |
| | 5857 | 2177 | FSFRSYSMN |
| | 5858 | 2178 | SISSSSTYINYADSVKG |
| | 5859 | 2179 | ARDLSPVERGPAFDI |
| | 5860 | 2180 | TCCTATGAGCTGACACAGCCACCCTCAGTGTCTGGGG<br>CCCCAGGGCAGAGGGTCACCATCTCCTGCACTGGGAG<br>CAGCTCCAACATCGGGGCAGGTTATGATGTACACTGG<br>TTCCAGCAGCTTCAGGAGCAGCCCCCAAACTCCTCA<br>TCTATGCTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA |

TABLE 6-continued

Informal Sequence Listing

| Antibody No. | Seq. Ref. No. | SEQ ID NO. | Sequence |
|---|---|---|---|
| | | | TTATTACTGCCAGTCCTATGACAGCAGACTGGGTGGTT CGGTATTCGGCGGAGGGACCAAGGTGACCGTCCTA |
| | 5861 | 2181 | SYELTQPPSVSGAPGQRVTISCTGSSSNIGAGYDVHWFQ QLPGAAPKLLIYANSNRPSGVPDRFSGSKSGTSASLAITG LQAEDEADYYCQSYDSRLGGSVFGGGTKVTVL |
| | 5862 | 2182 | TGSSSNIGAGYDVH |
| | 5863 | 2183 | ANSNRPS |
| | 5864 | 2184 | QSYDSRLGGSV |
| 369 (ADI-31345) | 5865 | 2185 | GAGGTGCAGCTGGTGGAGTCTGGGGGAGGCCTGGTCA AGCCTGGGGGGCCCTGAGACTCTCCTGTGCAGCCTC TGGATTCAGCTTCAGGAGCTATAGCATGAACTGGGTC CGCCAGGCTCCAGGGAAGGGGCTGGAGTGGGTCTCAT CCATTAGTGCTAGTAGTAATTACATAAACTACGCAGA CTCAGTGAAGGGCCGATTCAGCATCTCCAGAGACAAC GCCAAGAACTCACTGTATCTGCAAATGAACAGCCTGA GAGCCGAGGACACGGCTGTCTATTACTGTGCGAGAGA TTTGTTACCCGTCGAGCGGGGTCCCGCTTTTGATATCT GGGGCCAAGGGACAATGGTCACCGTCTCTTCA |
| | 5866 | 2186 | EVQLVESGGGLVKPGGALRLSCAASGFSFRSYSMNWVR QAPGKGLEWVSSISASSNYINYADSVKGRFSISRDNAKN SLYLQMNSLRAEDTAVYYCARDLLPVERGPAFDIWGQG TMVTVSS |
| | 5867 | 2187 | FSFRSYSMN |
| | 5868 | 2188 | SISASSNYINYADSVKG |
| | 5869 | 2189 | ARDLLPVERGPAFDI |
| | 5870 | 2190 | TCCTACGAGCTGACACAGCCACCCTCAGTGTCTGGGG CCCCAGGGCAGAGGGTCACTATCTCCTGCACTGGGAG CAGCTCCAACATCGGGAGGGGTTATGATGTACACTGG TTCCAGCAGCTTCCAGGAGCAGCCCCCAAACTCCTCA TCTATGCTAACAGCAATCGGCCCTCAGGGGTCCCTGA CCGATTCTCTGGCTCCAAGTCTGGCACCTCAGCCTCC TGGCCATCACTGGGCTCCAGGCTGAGGATGAGGCTGA TTATTACTGCCAGTCCTATGACAGCAGACTGGGTGGTT CGGTATTCGGCGGAGGGACCAAGGTGACCGTCCTA |
| | 5871 | 2191 | SYELTQPPSVSGAPGQRVTISCTGSSSNIGRGYDVHWFQ QLPGAAPKLLIYANSNRPSGVPDRFSGSKSGTSASLAITG LQAEDEADYYCQSYDSRLGGSVFGGGTKVTVL |
| | 5872 | 2192 | TGSSSNIGRGYDVH |
| | 5873 | 2193 | ANSNRPS |
| | 5874 | 2194 | QSYDSRLGGSV |
| 370 (ADI-31346) | 5875 | 2195 | GAGGTGCAGCTGGTGGAGTCTGGGGGAGGCCTGGTCA AGCCTGGGGGGCCCTGAGACTCTCCTGTGCAGCCTC TGGATTCAGCTTCAGGAGCTATAGCATGAACTGGGTC CGCCAGGCTCCAGGGAAGGGGCTGGAGTGGGTCTCAT CCATTAGTGCTAGTAGTAATTACATAAACTACGCAGA CTCAGTGAAGGGCCGATTCAGCATCTCCAGAGACAAC GCCAAGAACTCACTGTATCTGCAAATGAACAGCCTGA GAGCCGAGGACACGGCTGTCTATTACTGTGCGAGAGA TTTGTTACCCGTCGAGCGGGGTCCCGCTTTTGATATCT GGGGCCAAGGGACAATGGTCACCGTCTCTTCA |
| | 5876 | 2196 | EVQLVESGGGLVKPGGALRLSCAASGFSFRSYSMNWVR QAPGKGLEWVSSISASSNYINYADSVKGRFSISRDNAKN SLYLQMNSLRAEDTAVYYCARDLLPVERGPAFDIWGQG TMVTVSS |
| | 5877 | 2197 | FSFRSYSMN |
| | 5878 | 2198 | SISASSNYINYADSVKG |

TABLE 6-continued

Informal Sequence Listing

| Antibody No. | Seq. Ref. No. | SEQ ID NO. | Sequence |
|---|---|---|---|
| | 5879 | 2199 | ARDLLPVERGPAFDI |
| | 5880 | 2200 | TCCTATGAGCTGACACAGCCACCCTCAGTGTCTGGGG<br>CCCCAGGGCAGAGGGTCACCATCTCCTGCACTGGGAG<br>CAGCTCCAACATCGGGGCAGGTTATGATGTACACTGG<br>TTCCAGCAGCTTCCAGGAGCAGCCCCCAAACTCCTCA<br>TCTATCGTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCAGACTGGGTGGTT<br>CGAATTTCGGCGGAGGGACCAAGGTGACCGTCCTA |
| | 5881 | 2201 | SYELTQPPSVSGAPGQRVTISCTGSSSNIGAGYDVHWFQ<br>QLPGAAPKLLIYRNSNRPSGVPDRFSGSKSGTSASLAITG<br>LQAEDEADYYCQSYDSRLGGSNFGGGTKVTVL |
| | 5882 | 2202 | TGSSSNIGAGYDVH |
| | 5883 | 2203 | RNSNRPS |
| | 5884 | 2204 | QSYDSRLGGSN |
| 371 (ADI-31354) | 5885 | 2205 | GAGGTGCAGCTGGTGGAGTCTGGGGGAGGCCTGGTCA<br>AGCCTGGGGGGCCCTGAGACTCTCCTGTGCAGCCTC<br>TGGATTCAGCTTCAGGAGCTATAGCATGAACTGGGTC<br>CGCCAGGCTCCAGGGAAGGGGCTGGAGTGGGTCTCAT<br>CCATTAGTAGTAGTAGTACTTACATAAACTACGCAGA<br>CTCAGTGAAGGGCCGATTCAGCATCTCCAGAGACAAC<br>GCCAAGAACTCACTGTATCTGCAAATGAACAGCCTGA<br>GAGCCGAGGACACGGCTGTCTATTACTGTGCGAGAGA<br>TTTGAGTCCCGTCGAGCGGGTCCCGCTTTTGATATCT<br>GGGGCCAAGGGACAATGGTCACCGTCTCTTCA |
| | 5886 | 2206 | EVQLVESGGGLVKPGGALRLSCAASGFSFRSYSMNWVR<br>QAPGKGLEWVSSISSSSTYINYADSVKGRFSISRDNAKNS<br>LYLQMNSLRAEDTAVYYCARDLSPVERGPAFDIWGQGT<br>MVTVSS |
| | 5887 | 2207 | FSFRSYSMN |
| | 5888 | 2208 | SISSSSTYINYADSVKG |
| | 5889 | 2209 | ARDLSPVERGPAFDI |
| | 5890 | 2210 | TCCTACGAGCTGACACAGCCACCCTCAGTGTCTGGGG<br>CCCCAGGGCAGAGGGTCACTATCTCCTGCACTGGGAG<br>CAGCTCCAACATCGGGAGGGTTATGATGTACACTGG<br>TTCCAGCAGCTTCCAGGAGCAGCCCCCAAACTCCTCA<br>TCTATGCTAACAGCAATCGGCCCTCAGGGGTCCCTGA<br>CCGATTCTCTGGCTCCAAGTCTGGCACCTCAGCCTCCC<br>TGGCCATCACTGGGCTCCAGGCTGAGGATGAGGCTGA<br>TTATTACTGCCAGTCCTATGACAGCAGACTGGGTGGTT<br>CGGTATTCGGCGGAGGGACCAAGGTGACCGTCCTA |
| | 5891 | 2211 | SYELTQPPSVSGAPGQRVTISCTGSSSNIGRGYDVHWFQ<br>QLPGAAPKLLIYANSNRPSGVPDRFSGSKSGTSASLAITG<br>LQAEDEADYYCQSYDSRLGGSVFGGGTKVTVL |
| | 5892 | 2212 | TGSSSNIGRGYDVH |
| | 5893 | 2213 | ANSNRPS |
| | 5894 | 2214 | QSYDSRLGGSV |
| 372 (ADI-31362) | 5895 | 2215 | GAGGTGCAGCTGGTGGAGTCTGGGGGAGGCCTGGTCA<br>AGCCTGGGGGGCCCTGAGACTCTCCTGTGCAGCCTC<br>TGGATTCAGCTTCAGGAGCTATAGCATGAACTGGGTC<br>CGCCAGGCTCCAGGGAAGGGGCTGGAGTGGGTCTCAT<br>CCATTAGTAGTAGTAGTACTTACATAAACTACGCAGA<br>CTCAGTGAAGGGCCGATTCAGCATCTCCAGAGACAAC<br>GCCAAGAACTCACTGTATCTGCAAATGAACAGCCTGA<br>GAGCCGAGGACACGGCTGTCTATTACTGTGCGAGAGA<br>TTTGAGTCCCGTCGAGCGGGTCCCGCTTTTGATATCT<br>GGGGCCAAGGGACAATGGTCACCGTCTCTTCA |

TABLE 6-continued

Informal Sequence Listing

| Antibody No. | Seq. Ref. No. | SEQ ID NO. | Sequence |
|---|---|---|---|
| | 5896 | 2216 | EVQLVESGGGLVKPGGALRLSCAASGFSFRSYSMNWVRQAPGKGLEWVSSISSSSTYINYADSVKGRFSISRDNAKNSLYLQMNSLRAEDTAVYYCARDLSPVERGPAFDIWGQGTMVTVSS |
| | 5897 | 2217 | FSFRSYSMN |
| | 5898 | 2218 | SISSSSTYINYADSVKG |
| | 5899 | 2219 | ARDLSPVERGPAFDI |
| | 5900 | 2220 | TCCTATGAGCTGACACAGCCACCCTCAGTGTCTGGGGCCCCAGGGCAGAGGGTCACCATCTCCTGCACTGGGAGCAGCTCCAACATCGGGGCAGGTTATGATGTACACTGGTTCCAGCAGCTTCCAGGAGCAGCCCCCAAACTCCTCATCTATCGTAACAGCAATCGGCCCTCAGGGGTCCCTGACCGATTCTCTGGCTCCAAGTCTGGCACCTCAGCCTCCCTGGCCATCACTGGGCTCCAGGCTGAGGATGAGGCTGATTATTACTGCCAGTCCTATGACAGCAGACTGGGTGGTTCGAATTTCGGCGGAGGGACCAAGGTGACCGTCCTA |
| | 5901 | 2221 | SYELTQPPSVSGAPGQRVTISCTGSSSNIGAGYDVHWFQQLPGAAPKLLIYRNSNRPSGVPDRFSGSKSGTSASLAITGLQAEDEADYYCQSYDSRLGGSNFGGGTKVTVL |
| | 5902 | 2222 | TGSSSNIGAGYDVH |
| | 5903 | 2223 | RNSNRPS |
| | 5904 | 2224 | QSYDSRLGGSN |

Additional Embodiments

Embodiment 1. An isolated antibody or an antigen-binding fragment thereof that specifically binds to Respiratory Syncytial Virus (RSV) F protein (F), wherein at least one of the CDRH1, a CDRH2, a CDRH3, a CDRL1, a CDRL2, and CDRL3 amino acid sequence of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to at least one the CDRH1, a CDRH2, a CDRH3, a CDRL1, a CDRL2, and/or a CDRL3 amino acid sequences as disclosed in Table 6 of an antibody selected from Antibody Number 232 through Antibody Number 372 as disclosed in Table 6; and wherein said antibody or the antigen-binding fragment thereof also has one or more of the following characteristics:
  a) the antibody or antigen-binding fragment thereof cross-competes with said antibody ar antigen-binding fragment thereof for binding to RSV-F;
  b) the antibody or antigen-binding fragment thereof displays better binding affinity for the PreF form of RSV-F relative to the PostF form;
  c) the antibody or antigen-binding fragment thereof displays a clean or low polyreactivity profile;
  d) the antibody or antigen-binding fragment thereof displays neutralization activity toward RSV subtype A and RSV subtype B in vitro;
  e) the antibody or antigen-binding fragment thereof displays antigenic site specificity for RSV-F at Site Ø, Site I, Site II, Site III, Site IV, or Site V;
  f) the antibody or antigen-binding fragment thereof displays antigenic site specificity for RSV-F Site Ø, Site V, or Site III relative to RSV-F Site I, Site II, or Site IV;
  g) at least a portion of the epitope with which the antibody or antigen-binding fragment thereof interacts comprises the α3 helix and β3/β4 hairpin of PreF;
  h) the antibody or antigen-binding fragment thereof displays an in vitro neutralization potency ($IC_{50}$) of between about 0.5 microgram/milliliter (ug/ml) to about 5 ug/ml; between about 0.05 ug/ml to about 0.5 ug/ml; or less than about 0.05 mg/ml;
  i) the binding affinity and/or epitopic specificity of the antibody or antigen-binding fragment thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1;
  j) the antibody or antigen-binding fragment thereof of displays a cross-neutralization potency ($IC_{50}$) against human metapneumovirus (HMPV);
  k) the antibody or antigen-binding fragment thereof does not complete with D25, MPE8, palivizumab, motavizumab, or AM-14; or
  l) the antibody or antigen-binding fragment thereof displays at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

Embodiment 2. The isolated antibody or antigen-binding fragment thereof of Embodiment 1, wherein the antibody or antigen-binding fragment thereof comprises: at least two; at least three; at least 4; at least 5; at least 6; at least 7; at least 8; at least 9; at least 10; at least 11; or at least 12; of characteristics a) through l).

Embodiment 3. The isolated antibody or antigen-binding fragment thereof of Embodiment 1 or 2, wherein the antibody or antigen-binding fragment thereof comprises:
  a) the CDRH3 amino acid sequence of any one of the antibodies designated Antibody Number 232 through Antibody Number 372 as disclosed in Table 6;
  b) the CDRH2 amino acid sequence of any one of the antibodies designated Antibody Number 232 through Antibody Number 372 as disclosed in Table 6;
  c) the CDRH1 amino acid sequence of any one of the antibodies designated Antibody Number 232 through Antibody Number 372 as disclosed in Table 6;
  d) the CDRL3 amino acid sequence of any one of the antibodies designated Antibody Number 232 through Antibody Number 372 as disclosed in Table 6;
  e) the CDRL2 amino acid sequence of any one of the antibodies designated Antibody Number 232 through Antibody Number 372 as disclosed in Table 6;
  f) the CDRL1 amino acid sequence of any one of the antibodies designated Antibody Number 232 through Antibody Number 372 as disclosed in Table 6; or
  g) any combination of two or more of a), b), c), d), e), and f).

Embodiment 4. The isolated antibody or antigen-binding fragment thereof of any one of Embodiments 1 through 3, wherein the antibody or antigen-binding fragment thereof comprises:
  a) a heavy chain (HC) amino acid sequence of any one of the antibodies designated Antibody Number 232 through Antibody Number 372 as disclosed in Table 6; and/or
  b) a light chain (LC) amino acid sequence of any one of the antibodies designated Antibody Number 232 through Antibody Number 372 as disclosed in Table 6.

Embodiment 5. The isolated antibody or antigen-binding fragment thereof of any one of Embodiments 1 through 4, wherein the antibody is selected from the group consisting antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 232 through Antibody Number 372 as disclosed in Table 6.

Embodiment 6. The isolated antibody or antigen-binding fragment thereof of any one of Embodiments 1 through 5, wherein the antibody is selected from the group consisting of the antibodies designated as Antibody 232 through Antibody Number 372 as disclosed in Table 6.

Embodiment 7. An isolated nucleic acid sequence encoding an antibody or antigen-binding fragment thereof according to any one of Embodiments 1 through 6.

Embodiment 8. An expression vector comprising the isolated nucleic acid sequence according to Embodiment 7.

Embodiment 9. A host cell transfected, transformed, or transduced with the nucleic acid sequence according to Embodiment 7 or the expression vector according to Embodiment 8.

Embodiment 10. A pharmaceutical composition comprising: one or more of the isolated antibodies or antigen-binding fragments thereof according to any one of Embodiments 1 through 6; and a pharmaceutically acceptable carrier and/or excipient.

Embodiment 11. A pharmaceutical composition comprising: one or more nucleic acid sequences according to Embodiment 7; or one or more the expression vectors according to Embodiment 8; and a pharmaceutically acceptable carrier and/or excipient.

Embodiment 12. A transgenic organism comprising the nucleic acid sequence according to Embodiment 7; or the expression vector according to Embodiment 8.

Embodiment 13. A method of treating or preventing a Respiratory Syncytial Virus (RSV) infection, are at least one symptom associated with RSV infection, comprising administering to a patient in need thereof or suspected of being in need thereof:
  a) one or more antibodies or antigen-binding fragments thereof according to any of Embodiments 1 through 6;
  b) a nucleic acid sequences according to Embodiment 7;
  c) an expression vector according to Embodiment 8;
  d) a host cell according to Embodiment 9; or
  e) a pharmaceutical composition according Embodiment 10 or Embodiment 11; such that the RSV infection is treated or prevented, or the at least on symptom associated with RSV infection is treated, alleviated, or reduced in severity.

Embodiment 14. A method of treating or preventing either a Respiratory Syncytial Virus (RSV) infection or a human metapneumovirus (HMPV) infection, are at least one symptom associated with said RSV infection or said HMPV infection, comprising administering to a patient in need thereof or suspected of being in need thereof:
  a) one or more antibodies or antigen-binding fragments thereof according to any of Embodiments 1 through 6;
  b) a nucleic acid sequences according to Embodiment 7;
  c) an expression vector according to Embodiment 8;
  d) a host cell according to Embodiment 9; or
  e) a pharmaceutical composition according Embodiment 10 or Embodiment 11; such that the RSV infection is treated or prevented, or the at least on symptom associated with RSV infection is treated, alleviated, or reduced in severity.

Embodiment 15. The method according to Embodiment 14, wherein the one or more antibodies or antigen-binding fragments thereof comprises Antibody Number 340.

Embodiment 16. The method according to any one of Embodiments 13 through 15, wherein the method further comprises administering to the patient a second therapeutic agent.

Embodiment 17. The method according to Embodiment 16, wherein the second therapeutic agent is selected group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

Embodiment 18. A pharmaceutical composition comprising any one or more of the isolated antibodies or antigen-binding fragments thereof of any one of Embodiments 1 through 7 and a pharmaceutically acceptable carrier and/or excipient.

Embodiment 19. The pharmaceutical composition according to Embodiment 18 for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

Embodiment 20. The pharmaceutical composition according to Embodiment 18 for us in treating or preventing either a Respiratory Syncytial Virus (RSV) infection or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

Embodiment 21. Use of the pharmaceutical composition of Embodiment 18 in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

Embodiment 22. Use of the pharmaceutical composition of Embodiment 18 in the manufacture of a medicament for preventing either a Respiratory Syncytial Virus (RSV) infection or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

SEQUENCE LISTING (2229 sequences)

SEQ ID NO: 1 - DNA, 378 bp, Artificial Sequence
  Description of Artificial Sequence: Synthetic heavy chain variable region
caggtgcagctacagcagtggggcgcaggactgttgaagccttcggagaccctgtccctcacctgcgctgtctatggtgggtccttcagtggttattcctggagctggatccgccagaccccagggaaggggctggagtggattggggaaatcaatcatagaggaagcaccaactacaacccgtccctcaagagtcgagtcaccatgtcagtggacacgtcccagaaccagatctccctgagggtgacctctgtgaccgccgcggacacggctgtatatttctgtgcggggaccaattatggagaggttaatacgagtaaccagtacttcttcggtatggacgtctggggccaagggaccacggtcaccgtctcctca

SEQ ID NO: 2 - protein, 126 aa, Artificial Sequence
  Description of Artificial Sequence: Synthetic heavy chain variable region
QVQLQQWGAGLLKPSETLSLTCAVYGGSFSGYSWSWIRQTPGKGLEWIGEINHRGSTNYNPSLKSRVTMSVDTSQNQISLRVTSVTAADTAVYFCAGTNYGEVNTSNQYFFGMDVWGQGTTVTVSS

SEQ ID NO: 3 - protein, 9 aa, Artificial Sequence
  Description of Artificial Sequence: Synthetic heavy chain variable region CDR H1
GSFSGYSWS

SEQ ID NO: 4 - DNA, 27 bp, Artificial Sequence
  Description of Artificial Sequence: Synthetic heavy chain variable region CDR H1
gggtccttcagtggttattcctggagc

SEQ ID NO: 5 - protein, 16 aa, Artificial Sequence
  Description of Artificial Sequence: Synthetic heavy chain variable region CDR H2
EINHRGSTNYNPSLKS

SEQ ID NO: 6 - DNA, 48 bp, Artificial Sequence
  Description of Artificial Sequence: Synthetic heavy chain variable region CDR H2
gaaatcaatcatagaggaagcaccaactacaacccgtccctcaagagt

SEQ ID NO: 7 - protein, 20 aa, Artificial Sequence
  Description of Artificial Sequence: Synthetic heavy chain variable region CDR H3
AGTNYGEVNTSNQYFFGMDV

SEQ ID NO: 8 - DNA, 60 bp, Artificial Sequence
  Description of Artificial Sequence: Synthetic heavy chain variable region CDR H3
gcggggaccaattatggagaggttaatacgagtaaccagtacttcttcggtatggacgtc

SEQ ID NO: 9 - DNA, 321 bp, Artificial Sequence
  Description of Artificial Sequence: Synthetic light chain variable region
gacatccaggtgacccagtctccatcctccctgtctgcatctgtaggagacagagtcaccatcacttgccgggcaagtcagagcattggcacctatttaaattggtatcagcagaaaccagggaaaccccctaaactcctgatctatgctgcatccaatttggaaagtggggtcccatcaagtttcagtggcagtggatctgggacacatttcactctcaccatcagcagtctgcaacctgaacattttgcaacttactactgtcaacagagttacagtaccccgctcactttcggcggagggaccaaggtggaaatcaaa

SEQ ID NO: 10 - protein, 107 aa, Artificial Sequence
  Description of Artificial Sequence: Synthetic light chain variable region
DIQVTQSPSSLSASVGDRVTITCRASQSIGTYLNWYQQKPGKPPKLLIYAASNLESGVPSSFSGSGSGTHFTLTISSLQPEHFATYYCQQSYSTPLTFGGGTKVEIK

SEQ ID NO: 11 - protein, 11 aa, Artificial Sequence
  Description of Artificial Sequence: Synthetic light chain variable region CDR L1
RASQSIGTYLN

SEQ ID NO: 12 - DNA, 33 bp, Artificial Sequence
  Description of Artificial Sequence: Synthetic light chain variable region CDR L1
cgggcaagtcagagcattggcacctatttaaat

SEQ ID NO: 13 - protein, 7 aa, Artificial Sequence
  Description of Artificial Sequence: Synthetic light chain variable region CDR L2
AASNLES

SEQ ID NO: 14 - DNA, 21 bp, Artificial Sequence
  Description of Artificial Sequence: Synthetic light chain variable region CDR L2
gctgcatccaatttggaaagt

SEQ ID NO: 15 - protein, 9 aa, Artificial Sequence
  Description of Artificial Sequence: Synthetic light chain variable region CDR L3
QQSYSTPLT

SEQ ID NO: 16 - DNA, 27 bp, Artificial Sequence
  Description of Artificial Sequence: Synthetic light chain variable region CDR L3
caacagagttacagtaccccgctcact

SEQ ID NO: 17 - DNA, 384 bp, Artificial Sequence
  Description of Artificial Sequence: Synthetic heavy chain variable region
caggtgcagctgcaggagtcgggcccaggactggtgaagccttcacagaccctgtccctcacctgcactgtctctggtccctccatcagcagtggtgattactactggacttggatccgccagcccccagggaagggcctggagtggattggctacatctataacagtgggagcaccgactacaacccgtccctcaagagtcgtatcaccatgtcactagacaggtccaagaaccagttctccctgaatctgagctctgtgactgccgcagacacggccgtgtatttctgtgccagggatgtgggtactctggtactaccaactgttgcttactactacggcatggacgtctggggccaagggaccacggtcaccgtctcctca

SEQ ID NO: 18 - protein, 128 aa, Artificial Sequence
  Description of Artificial Sequence: Synthetic heavy chain variable region
QVQLQESGPGLVKPSQTLSLTCTVSGPSISSGDYYWTWIRQPPGKGLEWIGYIYNSGSTDYNPSLKSRITMSLDRSKNQFSLNLSSVTAADTAVYFCARDVGTLVLPTVAYYYGMDVWGQGTTVTVSS

SEQ ID NO: 19 - protein, 11 aa, Artificial Sequence
  Description of Artificial Sequence: Synthetic heavy chain variable region CDR H1
PSISSGDYYWT

SEQ ID NO: 20 - DNA, 33 bp, Artificial Sequence
  Description of Artificial Sequence: Synthetic heavy chain variable region CDR H1
ccctccatcagcagtggtgattactactggact

SEQ ID NO: 21 - protein, 16 aa, Artificial Sequence
  Description of Artificial Sequence: Synthetic heavy chain variable region CDR H2
YIYNSGSTDYNPSLKS

SEQ ID NO: 22 - DNA, 48 bp, Artificial Sequence
  Description of Artificial Sequence: Synthetic heavy chain variable region CDR H2
tacatctataacagtgggagcaccgactacaacccgtccctcaagagt

SEQ ID NO: 23 - protein, 20 aa, Artificial Sequence
  Description of Artificial Sequence: Synthetic heavy chain variable region CDR H3
ARDVGTLVLPTVAYYYGMDV

SEQ ID NO: 24 - DNA, 60 bp, Artificial Sequence
  Description of Artificial Sequence: Synthetic heavy chain variable region CDR H3
gccagggatgtgggtactctggtactaccaactgttgcttactactacggcatggacgtc

SEQ ID NO: 25 - DNA, 327 bp, Artificial Sequence
  Description of Artificial Sequence: Synthetic light chain variable region
gaaattgtattgacgcagtctccaggcaccctgtctttgtctccgggggaaagagccaccctctcctgcagggccagtgagagtattagcagcagctacttagcctggtaccagcagaaacctggccaggctcccagactcctcatctatgatgcgtccagcagggccactggcatcccagacaggttcagtggcagtgggtctgggacagacttcactctcaccatcagcagtctggagcctgaagattttgcagtgtattactgtcagcagtatggtagctcacccctggtcactttcggccctgggaccaaagtggatatcaaa

SEQ ID NO: 26 - protein, 109 aa, Artificial Sequence
  Description of Artificial Sequence: Synthetic light chain variable region
EIVLTQSPGTLSLSPGERATLSCRASESISSSYLAWYQQKPGQAPRLLIYDASSRATGIPDRFSGSGSGTDFTLTISSLEPEDFAVYYCQQYGSSPLVTFGPGTKVDIK

SEQ ID NO: 27 - protein, 12 aa, Artificial Sequence
  Description of Artificial Sequence: Synthetic light chain variable region CDR L1
RASESISSSYLA

SEQ ID NO: 28 - DNA, 36 bp, Artificial Sequence
  Description of Artificial Sequence: Synthetic light chain variable region CDR L1
agggccagtgagagtattagcagcagctacttagcc

SEQ ID NO: 29 - protein, 7 aa, Artificial Sequence
  Description of Artificial Sequence: Synthetic light chain variable region CDR L2
DASSRAT

SEQ ID NO: 30 - DNA, 21 bp, Artificial Sequence
  Description of Artificial Sequence: Synthetic light chain variable region CDR L2
gatgcgtccagcagggccact

SEQ ID NO: 31 - protein, 10 aa, Artificial Sequence
  Description of Artificial Sequence: Synthetic light chain variable region CDR L3
QQYGSSPLVT

SEQ ID NO: 32 - DNA, 30 bp, Artificial Sequence
  Description of Artificial Sequence: Synthetic light chain variable region CDR L3
cagcagtatggtagctcacccctggtcact

SEQ ID NO: 33 - DNA, 363 bp, Artificial Sequence
  Description of Artificial Sequence: Synthetic heavy chain variable region
caggtccagctggtgcagtctggaactgaggtgaagaagcctggggcctcagtgaaggtctcctgtaaggctgctggttacacctttagcaactacggtgtcagttgggtgcgacaggcccctggacaggggcttgagtggatgggatggatcagcgcttataatggtaacacaaaatttgcacagaaggtccagggcagactcaccatgaccacagacacatctaccagcacagcctacatggaattgaggaacctcagatctgacgacacggccgtgtattattgtgcgagagaatcaggggcaacagcggctgctatgtttgactactggggccagggaaccctggtcaccgtctcctca

SEQ ID NO: 34 - protein, 121 aa, Artificial Sequence
  Description of Artificial Sequence: Synthetic heavy chain variable region
QVQLVQSGTEVKKPGASVKVSCKAAGYTFSNYGVSWVRQAPGQGLEWMGWISAYNGNTKFAQKVQGRLTMTTDTSTSTAYMELRNLRSDDTAVYYCARESGATAAAMFDYWGQGTLVTVSS

SEQ ID NO: 35 - protein, 9 aa, Artificial Sequence
  Description of Artificial Sequence: Synthetic heavy chain variable region CDR H1
YTFSNYGVS

SEQ ID NO: 36 - DNA, 27 bp, Artificial Sequence
  Description of Artificial Sequence: Synthetic heavy chain variable region CDR H1
tacacctttagcaactacggtgtcagt

SEQ ID NO: 37 - protein, 17 aa, Artificial Sequence
  Description of Artificial Sequence: Synthetic heavy chain variable region CDR H2
WISAYNGNTKFAQKVQG

SEQ ID NO: 38 - DNA, 51 bp, Artificial Sequence
  Description of Artificial Sequence: Synthetic heavy chain variable region CDR H2
tggatcagcgcttataatggtaacacaaaatttgcacagaaggtccagggc

SEQ ID NO: 39 - protein, 14 aa, Artificial Sequence
  Description of Artificial Sequence: Synthetic heavy chain variable region CDR H3
ARESGATAAAMFDY

SEQ ID NO: 40 - DNA, 42 bp, Artificial Sequence
  Description of Artificial Sequence: Synthetic heavy chain variable region CDR H3
gcgagagaatcaggggcaacagcggctgctatgtttgactac

SEQ ID NO: 41 - DNA, 336 bp, Artificial Sequence
  Description of Artificial Sequence: Synthetic light chain variable region
gaaacgacactcacgcagtctccactctccctgcccgtcacccttggacagccggcctccatctcctgcaggtctagtcaaagcctcgaatacagtgatggaaacatctacttgagttggtttcaacagaggccaggccaatctccaaggcgcctaatttataaggtttctcaccgggactctggggtcccagacagattcagcggcagtgggtcaggcactgatttcacactgaaaatcgccagggtggaggctgaggatgttgcagtttattactgcatgcaagctatacactggcctcgaacttttggccaggggaccaaagtggatatcaaa

SEQ ID NO: 42 - protein, 112 aa, Artificial Sequence
  Description of Artificial Sequence: Synthetic light chain variable region
ETTLTQSPLSLPVTLGQPASISCRSSQSLEYSDGNIYLSWFQQRPGQSPRRLIYKVSHRDSGVPDRFSGSGSGTDFTLKIARVEAEDVAVYYCMQAIHWPRTFGQGTKVDIK

SEQ ID NO: 43 - protein, 16 aa, Artificial Sequence
  Description of Artificial Sequence: Synthetic light chain variable region CDR L1
RSSQSLEYSDGNIYLS

SEQ ID NO: 44 - DNA, 48 bp, Artificial Sequence
  Description of Artificial Sequence: Synthetic light chain variable region CDR L1
aggtctagtcaaagcctcgaatacagtgatggaaacatctacttgagt

SEQ ID NO: 45 - protein, 7 aa, Artificial Sequence
  Description of Artificial Sequence: Synthetic light chain variable region CDR L2
KVSHRDS

SEQ ID NO: 46 - DNA, 21 bp, Artificial Sequence
  Description of Artificial Sequence: Synthetic light chain variable region CDR L2
aaggtttctcaccgggactct

SEQ ID NO: 47 - protein, 9 aa, Artificial Sequence
  Description of Artificial Sequence: Synthetic light chain variable region CDR L3
MQAIHWPRT

SEQ ID NO: 48 - DNA, 27 bp, Artificial Sequence
  Description of Artificial Sequence: Synthetic light chain variable region CDR L3
atgcaagctatacactggcctcgaact

SEQ ID NO: 49 - DNA, 378 bp, Artificial Sequence
  Description of Artificial Sequence: Synthetic heavy chain variable region
caggtgcagctgcaggagtcgggcccaagactggtgaagccttcacagaccctgtccctcatctgcgatgtctctggtggctccatcggcagtggtgaccactactggagttggatccgccagccccccgggaagggcctcgagtggattgggtacatctattacagtgggaccacttactacaacccgtccctcaagagtcgagtgaccatttcagcagacacgtccaagaaccagttgtccctgaaattgagttctgtgactgccgcagacacggccatttatttctgtgccagagatgggggttatgatcacgtctgggggactcatcgttatttcgacaagtggggccagggaaccctggtcaccgtctcctca

SEQ ID NO: 50 - protein, 126 aa, Artificial Sequence
  Description of Artificial Sequence: Synthetic heavy chain variable region
QVQLQESGPRLVKPSQTLSLICDVSGGSIGSGDHYWSWIRQPPGKGLEWIGYIYYSGTTYYNPSLKSRVTISADTSKNQLSLKLSSVTAADTAIYFCARDGGYDHVWGTHRYFDKWGQGTLVTVSS

SEQ ID NO: 51 - protein, 11 aa, Artificial Sequence
  Description of Artificial Sequence: Synthetic heavy chain variable region CDR H1
GSIGSGDHYWS

SEQ ID NO: 52 - DNA, 33 bp, Artificial Sequence
  Description of Artificial Sequence: Synthetic heavy chain variable region CDR H1
ggctccatcggcagtggtgaccactactggagt

SEQ ID NO: 53 - protein, 16 aa, Artificial Sequence
  Description of Artificial Sequence: Synthetic heavy chain variable region CDR H2
YIYYSGTTYYNPSLKS

SEQ ID NO: 54 - DNA, 48 bp, Artificial Sequence
  Description of Artificial Sequence: Synthetic heavy chain variable region CDR H2
tacatctattacagtgggaccacttactacaacccgtccctcaagagt

SEQ ID NO: 55 - protein, 18 aa, Artificial Sequence
  Description of Artificial Sequence: Synthetic heavy chain variable region CDR H3
ARDGGYDHVWGTHRYFDK

SEQ ID NO: 56 - DNA, 54 bp, Artificial Sequence
  Description of Artificial Sequence: Synthetic heavy chain variable region CDR H3
gccagagatgggggttatgatcacgtctgggggactcatcgttatttcgacaag

SEQ ID NO: 57 - DNA, 324 bp, Artificial Sequence
  Description of Artificial Sequence: Synthetic light chain variable region
gaaattgtattgacacagtctccaggcaccctgtctttgtctcccggggaaagagccaccctctcctgcagggccagtcagagtgttagcaacagttacttagcctggtaccagcagaaacctggccaggctcccaggctcctcatctatggtgtttccaccagggccactggcatcccagaccggttcagtggcagcgggtctgggacagacttcaccctcaccatcagcagactggaacctgaagattttgcaatgtatcactgtcagcagtatggtgcctcaccttggacgttcggccaagggaccaaagtggatatcaaa

SEQ ID NO: 58 - protein, 108 aa, Artificial Sequence
  Description of Artificial Sequence: Synthetic light chain variable region
EIVLTQSPGTLSLSPGERATLSCRASQSVSNSYLAWYQQKPGQAPRLLIYGVSTRATGIPDRFSGSGSGTDFTLTISRLEPEDFAMYHCQQYGASPWTFGQGTKVDIK

SEQ ID NO: 59 - protein, 12 aa, Artificial Sequence
  Description of Artificial Sequence: Synthetic light chain variable region CDR L1
RASQSVSNSYLA

SEQ ID NO: 60 - DNA, 36 bp, Artificial Sequence
  Description of Artificial Sequence: Synthetic light chain variable region CDR L1
agggccagtcagagtgttagcaacagttacttagcc

SEQ ID NO: 61 - protein, 7 aa, Artificial Sequence
  Description of Artificial Sequence: Synthetic light chain variable region CDR L2
GVSTRAT

SEQ ID NO: 62 - DNA, 21 bp, Artificial Sequence
  Description of Artificial Sequence: Synthetic light chain variable region CDR L2
ggtgtttccaccagggccact

SEQ ID NO: 63 - protein, 9 aa, Artificial Sequence
  Description of Artificial Sequence: Synthetic light chain variable region CDR L3
QQYGASPWT

SEQ ID NO: 64 - DNA, 27 bp, Artificial Sequence
  Description of Artificial Sequence: Synthetic light chain variable region CDR L3
cagcagtatggtgcctcaccttggacg

SEQ ID NO: 65 - DNA, 363 bp, Artificial Sequence
  Description of Artificial Sequence: Synthetic heavy chain variable region
gaggtgcagctgttggagtctggaggtgaggtgaagaagcctggggcctcagtgaaggtctcctgcagggcctctggttacacctttagaaactatggcctcacctgggtgcggcaggcccccggacaagggcttgagtggatgggatggatcagcgcttacaatggaaacacaaactatgcacagaagttccagggcagagtcacactgaccacggacacatccacgagcacagcctacatggaactgaggagcctaagatctgacgacacggccgtgtatttctgtgcgagagacgtccccggccacggcgctgccttcatggacgtctggggcacagggaccacggtcaccgtctcctca

SEQ ID NO: 66 - protein, 121 aa, Artificial Sequence
  Description of Artificial Sequence: Synthetic heavy chain variable region
EVQLLESGGEVKKPGASVKVSCRASGYTFRNYGLTWVRQAPGQGLEWMGWISAYNGNTNYAQKFQGRVTLTTDTSTSTAYMELRSLRSDDTAVYFCARDVPGHGAAFMDVWGTGTTVTVSS

SEQ ID NO: 67 - protein, 9 aa, Artificial Sequence
  Description of Artificial Sequence: Synthetic heavy chain variable region CDR H1
YTFRNYGLT

SEQ ID NO: 68 - DNA, 27 bp, Artificial Sequence
  Description of Artificial Sequence: Synthetic heavy chain variable region CDR H1
tacacctttagaaactatggcctcacc

SEQ ID NO: 69 - protein, 17 aa, Artificial Sequence
  Description of Artificial Sequence: Synthetic heavy chain variable region CDR H2
WISAYNGNTNYAQKFQG

SEQ ID NO: 70 - DNA, 51 bp, Artificial Sequence
  Description of Artificial Sequence: Synthetic heavy chain variable region CDR H2
tggatcagcgcttacaatggaaacacaaactatgcacagaagttccagggc

SEQ ID NO: 71 - protein, 14 aa, Artificial Sequence
  Description of Artificial Sequence: Synthetic heavy chain variable region CDR H3
ARDVPGHGAAFMDV

SEQ ID NO: 72 - DNA, 42 bp, Artificial Sequence
  Description of Artificial Sequence: Synthetic heavy chain variable region CDR H3
gcgagagacgtccccggccacggcgctgccttcatggacgtc

SEQ ID NO: 73 - DNA, 336 bp, Artificial Sequence
  Description of Artificial Sequence: Synthetic light chain variable region
gacatccagttgacccagtctccactctccctgcccgtcacccttgggcagccggcctccatctcctgcaggtctagtcaaagcctcgaagccagtgatacaaatatctacttgagttggtttcagcagaggccaggccaatctccaaggcgcctaatttataagatttctaaccgagactctggggtcccagacagattcagcggcagtgggtcaggcactcatttcacactgagaatcagcagggtggaggctgacgatgttgcggtttattactgcatgcagggtacacactggcctccggcgttcggccaggggaccaaagtggatatcaaa

SEQ ID NO: 74 - protein, 112 aa, Artificial Sequence
  Description of Artificial Sequence: Synthetic light chain variable region
DIQLTQSPLSLPVTLGQPASISCRSSQSLEASDTNIYLSWFQQRPGQSPRRLIYKISNRDSGVPDRFSGSGSGTHFTLRISRVEADDVAVYYCMQGTHWPPAFGQGTKVDIK

SEQ ID NO: 75 - protein, 16 aa, Artificial Sequence
  Description of Artificial Sequence: Synthetic light chain variable region CDR L1
RSSQSLEASDTNIYLS

SEQ ID NO: 76 - DNA, 48 bp, Artificial Sequence
  Description of Artificial Sequence: Synthetic light chain variable region CDR L1
aggtctagtcaaagcctcgaagccagtgatacaaatatctacttgagt

SEQ ID NO: 77 - protein, 7 aa, Artificial Sequence
  Description of Artificial Sequence: Synthetic light chain variable region CDR L2
KISNRDS

SEQ ID NO: 78 - DNA, 21 bp, Artificial Sequence
  Description of Artificial Sequence: Synthetic light chain variable region CDR L2
aagatttctaaccgagactct

SEQ ID NO: 79 - protein, 9 aa, Artificial Sequence
  Description of Artificial Sequence: Synthetic light chain variable region CDR L3
MQGTHWPPA

SEQ ID NO: 80 - DNA, 27 bp, Artificial Sequence
  Description of Artificial Sequence: Synthetic light chain variable region CDR L3
atgcagggtacacactggcctccggcg

SEQ ID NO: 81 - DNA, 363 bp, Artificial Sequence
  Description of Artificial Sequence: Synthetic heavy chain variable region
caggtccagctggtacagtctggatctgaggtgaagaagcctggggccgcagtgaaggtctcctgcaaggcttctggttacatctttgccaactttggtgtcagctgggtgcgacaggcccctggacaagggcttgagtggatgggatggatcagcgcttacaatggtaacacaaactatgcacagaagttccagggcagagtcatcatgaccacagacacatccacgagcacagcctacatggagctgaggagcctgagatctgacgacacggccgtgtattattgtgcgagagacccccccgcctacgccgctacattgatggacgtctggggcaaagggaccacggtcactgtctcctca

SEQ ID NO: 82 - protein, 121 aa, Artificial Sequence
  Description of Artificial Sequence: Synthetic heavy chain variable region
QVQLVQSGSEVKKPGAAVKVSCKASGYIFANFGVSWVRQAPGQGLEWMGWISAYNGNTNYAQKFQGRVIMTTDTSTSTAYMELRSLRSDDTAVYYCARDPPAYAATLMDVWGKGTTVTVSS

SEQ ID NO: 83 - protein, 9 aa, Artificial Sequence
  Description of Artificial Sequence: Synthetic heavy chain variable region CDR H1
YIFANFGVS

SEQ ID NO: 84 - DNA, 27 bp, Artificial Sequence
  Description of Artificial Sequence: Synthetic heavy chain variable region CDR H1
tacatctttgccaactttggtgtcagc

SEQ ID NO: 85 - protein, 17 aa, Artificial Sequence
  Description of Artificial Sequence: Synthetic heavy chain variable region CDR H2
WISAYNGNTNYAQKFQG

SEQ ID NO: 86 - DNA, 51 bp, Artificial Sequence
  Description of Artificial Sequence: Synthetic heavy chain variable region CDR H2
tggatcagcgcttacaatggtaacacaaactatgcacagaagttccagggc

SEQ ID NO: 87 - protein, 14 aa, Artificial Sequence
  Description of Artificial Sequence: Synthetic heavy chain variable region CDR H3
ARDPPAYAATLMDV

SEQ ID NO: 88 - DNA, 42 bp, Artificial Sequence
  Description of Artificial Sequence: Synthetic heavy chain variable region CDR H3
gcgagagacccccccgcctacgccgctacattgatggacgtc

SEQ ID NO: 89 - DNA, 336 bp, Artificial Sequence
  Description of Artificial Sequence: Synthetic light chain variable region
gaaattgtattgacgcagtctccactctccctgcccgtcacccttggacagtcggcctccatctcctgcaggtctagtcaaagcctcgaacacagtgatacaaacacctacttgacttggtatcagcagaggccaggccaatctccaaggcggctactttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccaagggaccaaagtggatatcaaa

SEQ ID NO: 90 - protein, 112 aa, Artificial Sequence
  Description of Artificial Sequence: Synthetic light chain variable region
EIVLTQSPLSLPVTLGQSASISCRSSQSLEHSDTNTYLTWYQQRPGQSPRRLLYKVSNRDSGVPDRFSGSGSGTDFTLKISRVEAEDVGVYYCMQGTHWPPTFGQGTKVDIK

SEQ ID NO: 91 - protein, 16 aa, Artificial Sequence
  Description of Artificial Sequence: Synthetic light chain variable region CDR L1
RSSQSLEHSDTNTYLT

SEQ ID NO: 92 - DNA, 48 bp, Artificial Sequence
  Description of Artificial Sequence: Synthetic light chain variable region CDR L1
aggtctagtcaaagcctcgaacacagtgatacaaacacctacttgact

SEQ ID NO: 93 - protein, 7 aa, Artificial Sequence
  Description of Artificial Sequence: Synthetic light chain variable region CDR L2
KVSNRDS

SEQ ID NO: 94 - DNA, 21 bp, Artificial Sequence
  Description of Artificial Sequence: Synthetic light chain variable region CDR L2
aaggtttctaaccgggactct

SEQ ID NO: 95 - protein, 9 aa, Artificial Sequence
  Description of Artificial Sequence: Synthetic light chain variable region CDR L3
MQGTHWPPT

SEQ ID NO: 96 - DNA, 27 bp, Artificial Sequence
  Description of Artificial Sequence: Synthetic light chain variable region CDR L3
atgcaaggtacacactggcctccgacg

SEQ ID NO: 97 - DNA, 375 bp, Artificial Sequence
  Description of Artificial Sequence: Synthetic heavy chain variable region
caggtccagcttgtacagtctggggctgaggtgaagaagcctgggtcctcggtgagggtctcctgcaaggcctctggaggcaccttcaggggctatggtctcagctgggtgcgacaggcccctggacagggactcgagtggatgggagggatcacccatctttttgggacagtcagctacgctccgaagttccagggcagactcacgatcaccgcggacgcatccacgggcacagcctacatggagctgagcagcctgatatctgaggacacggccgtatatttttgtgcgagagatgcttacgaagtgtggaccggctcttatctccccccttttgactactggggccagggaacaatggtcaccgtctcttca

SEQ ID NO: 98 - protein, 125 aa, Artificial Sequence
  Description of Artificial Sequence: Synthetic heavy chain variable region
QVQLVQSGAEVKKPGSSVRVSCKASGGTFRGYGLSWVRQAPGQGLEWMGGITHLFGTVSYAPKFQGRLTITADASTGTAYMELSSLISEDTAVYFCARDAYEVWTGSYLPPFDYWGQGTMVTVSS

SEQ ID NO: 99 - protein, 9 aa, Artificial Sequence
  Description of Artificial Sequence: Synthetic heavy chain variable region CDR H1
GTFRGYGLS

SEQ ID NO: 100 - DNA, 27 bp, Artificial Sequence
  Description of Artificial Sequence: Synthetic heavy chain variable region CDR H1
ggcaccttcaggggctatggtctcagc

SEQ ID NO: 101 - protein, 17 aa, Artificial Sequence
  Description of Artificial Sequence: Synthetic heavy chain variable region CDR H2
GITHLFGTVSYAPKFQG

SEQ ID NO: 102 - DNA, 51 bp, Artificial Sequence
  Description of Artificial Sequence: Synthetic heavy chain variable region CDR H2
gggatcacccatctttttgggacagtcagctacgctccgaagttccagggc

SEQ ID NO: 103 - protein, 18 aa, Artificial Sequence
  Description of Artificial Sequence: Synthetic heavy chain variable region CDR H3
ARDAYEVWTGSYLPPFDY

SEQ ID NO: 104 - DNA, 54 bp, Artificial Sequence
  Description of Artificial Sequence: Synthetic heavy chain variable region CDR H3
gcgagagatgcttacgaagtgtggaccggctcttatctccccccttttgactac

SEQ ID NO: 105 - DNA, 324 bp, Artificial Sequence
  Description of Artificial Sequence: Synthetic light chain variable region
gatattgtgatgactcagtctccaggcaccctgtctttgtctcccggggaaagagtcaccctctcctgcagggccagtcagattattccaagcagttacttagcctggtaccagcagaaacctggccaggctcccaggctcctcatctatggtgcattcaccagggccactgacatcccagacaggttcagtggcagtgggtctgggacagacttcactctcaccatcagcagactggagcctgaagattttgcagtatattattgtcagcagtatggtagttcatttctcactttcggcggagggaccaaggtggaaatcaaa

SEQ ID NO: 106 - protein, 108 aa, Artificial Sequence
  Description of Artificial Sequence: Synthetic light chain variable region
DIVMTQSPGTLSLSPGERVTLSCRASQIIPSSYLAWYQQKPGQAPRLLIYGAFTRATDIPDRFSGSGSGTDFTLTISRLEPEDFAVYYCQQYGSSFLTFGGGTKVEIK

SEQ ID NO: 107 - protein, 12 aa, Artificial Sequence
  Description of Artificial Sequence: Synthetic light chain variable region CDR L1
RASQIIPSSYLA

SEQ ID NO: 108 - DNA, 36 bp, Artificial Sequence
  Description of Artificial Sequence: Synthetic light chain variable region CDR L1
agggccagtcagattattccaagcagttacttagcc

SEQ ID NO: 109 - protein, 7 aa, Artificial Sequence
  Description of Artificial Sequence: Synthetic light chain variable region CDR L2
GAFTRAT

SEQ ID NO: 110 - DNA, 21 bp, Artificial Sequence
  Description of Artificial Sequence: Synthetic light chain variable region CDR L2
ggtgcattcaccagggccact

SEQ ID NO: 111 - protein, 9 aa, Artificial Sequence
  Description of Artificial Sequence: Synthetic light chain variable region CDR L3
QQYGSSFLT

SEQ ID NO: 112 - DNA, 27 bp, Artificial Sequence
  Description of Artificial Sequence: Synthetic light chain variable region CDR L3
cagcagtatggtagttcatttctcact

SEQ ID NO: 113 - DNA, 366 bp, Artificial Sequence
  Description of Artificial Sequence: Synthetic heavy chain variable region
caggtccagcttgtgcagtctgggcctgaggtaaagaagcctgggtcctcagtgacggtctcctgcaaggcttctggaggcaccttcagcaactatggtattgcttgggtgcgacaggcccctggacaagggcttgagtggatgggatcaacaatccctatccttggaacagcaagctacagacagagcttaaaggacagagtcacaattaccgcggacgcttccacgaccacagtctacatggaaatgactcgcctcagaactgaggacacggccgtctatttttgtgcgagagttccggagagtcttgtggcatcaaacgcttatgctgtttggggccaagggacggtggtcactgtctcctca

SEQ ID NO: 114 - protein, 122 aa, Artificial Sequence
  Description of Artificial Sequence: Synthetic heavy chain variable region
QVQLVQSGPEVKKPGSSVTVSCKASGGTFSNYGIAWVRQAPGQGLEWMGSTIPILGTASYRQSLKDRVTITADASTTTVYMEMTRLRTEDTAVYFCARVPESLVASNAYAVWGQGTVVTVSS

SEQ ID NO: 115 - protein, 9 aa, Artificial Sequence
  Description of Artificial Sequence: Synthetic heavy chain variable region CDR H1
GTFSNYGIA

SEQ ID NO: 116 - DNA, 27 bp, Artificial Sequence
  Description of Artificial Sequence: Synthetic heavy chain variable region CDR H1
ggcaccttcagcaactatggtattgct

SEQ ID NO: 117 - protein, 17 aa, Artificial Sequence
  Description of Artificial Sequence: Synthetic heavy chain variable region CDR H2
STIPILGTASYRQSLKD

SEQ ID NO: 118 - DNA, 51 bp, Artificial Sequence
  Description of Artificial Sequence: Synthetic heavy chain variable region CDR H2
tcaacaatccctatccttggaacagcaagctacagacagagcttaaaggac

SEQ ID NO: 119 - protein, 15 aa, Artificial Sequence
  Description of Artificial Sequence: Synthetic heavy chain variable region CDR H3
ARVPESLVASNAYAV

SEQ ID NO: 120 - DNA, 45 bp, Artificial Sequence
  Description of Artificial Sequence: Synthetic heavy chain variable region CDR H3
gcgagagttccggagagtcttgtggcatcaaacgcttatgctgtt

SEQ ID NO: 121 - DNA, 321 bp, Artificial Sequence
  Description of Artificial Sequence: Synthetic light chain variable region
gacatccagatgacccagtctccatcttccgtgtctgcatctgtaggagacagagtcaccatcacttgtcgggcgagccaggacattagcacctggttagcctggtatcagcagagaccagggaaagccccaaaactcctgatctacactgcatccagtttgcaaagtggggtcccatcaaggttcagcggcagtggatctgggacagagttcactctcaccatcagcagcctgcagcctgaagattttgcaacttactattgtcaacagggtaccagtttcccattcactttcggccctgggaccaagctggagatcaaa

SEQ ID NO: 122 - protein, 107 aa, Artificial Sequence
  Description of Artificial Sequence: Synthetic light chain variable region
DIQMTQSPSSVSASVGDRVTITCRASQDISTWLAWYQQRPGKAPKLLIYTASSLQSGVPSRFSGSGSGTEFTLTISSLQPEDFATYYCQQGTSFPFTFGPGTKLEIK

SEQ ID NO: 123 - protein, 11 aa, Artificial Sequence
  Description of Artificial Sequence: Synthetic light chain variable region CDR L1
RASQDISTWLA

SEQ ID NO: 124 - DNA, 33 bp, Artificial Sequence
  Description of Artificial Sequence: Synthetic light chain variable region CDR L1
cgggcgagccaggacattagcacctggttagcc

SEQ ID NO: 125 - protein, 7 aa, Artificial Sequence
  Description of Artificial Sequence: Synthetic light chain variable region CDR L2
TASSLQS

SEQ ID NO: 126 - DNA, 21 bp, Artificial Sequence
  Description of Artificial Sequence: Synthetic light chain variable region CDR L2
actgcatccagtttgcaaagt

SEQ ID NO: 127 - protein, 9 aa, Artificial Sequence
  Description of Artificial Sequence: Synthetic light chain variable region CDR L3
QQGTSFPFT

SEQ ID NO: 128 - DNA, 27 bp, Artificial Sequence
  Description of Artificial Sequence: Synthetic light chain variable region CDR L3
caacagggtaccagtttcccattcact

SEQ ID NO: 129 - DNA, 372 bp, Artificial Sequence
  Description of Artificial Sequence: Synthetic heavy chain variable region
gaggtgcagctggtggagtctggggctgagatgaagaagcctggggcctcagtgaaggtttcctgcaaggcttctggatacaccttcactaactatgctatacattgggtgcgccaggcccccggccaaagccttgagtggatgggatggatcaacgctggcaatggtaacacacaatattcacagaagttccagggcagagtcacctttaccagggacacatccgcgagcacggtctacatggacctgagcagcctgagatctgaagacacggctgtctattactgtgcgagaggccaaattgttgttataccacgtgctaatttctggttcgacccctggggccagggaaccctggtcaccgtctcctca

SEQ ID NO: 130 - protein, 124 aa, Artificial Sequence
  Description of Artificial Sequence: Synthetic heavy chain variable region
EVQLVESGAEMKKPGASVKVSCKASGYTFTNYAIHWVRQAPGQSLEWMGWINAGNGNTQYSQKFQGRVTFTRDTSASTVYMDLSSLRSEDTAVYYCARGQIVVIPRANFWFDPWGQGTLVTVSS

SEQ ID NO: 131 - protein, 9 aa, Artificial Sequence
  Description of Artificial Sequence: Synthetic heavy chain variable region CDR H1
YTFTNYAIH

SEQ ID NO: 132 - DNA, 27 bp, Artificial Sequence
  Description of Artificial Sequence: Synthetic heavy chain variable region CDR H1
tacaccttcactaactatgctatacat

SEQ ID NO: 133 - protein, 17 aa, Artificial Sequence
  Description of Artificial Sequence: Synthetic heavy chain variable region CDR H2
WINAGNGNTQYSQKFQG

SEQ ID NO: 134 - DNA, 51 bp, Artificial Sequence
  Description of Artificial Sequence: Synthetic heavy chain variable region CDR H2
tggatcaacgctggcaatggtaacacacaatattcacagaagttccagggc

SEQ ID NO: 135 - protein, 17 aa, Artificial Sequence
  Description of Artificial Sequence: Synthetic heavy chain variable region CDR H3
ARGQIVVIPRANFWFDP

SEQ ID NO: 136 - DNA, 51 bp, Artificial Sequence
  Description of Artificial Sequence: Synthetic heavy chain variable region CDR H3
gcgagaggccaaattgttgttataccacgtgctaatttctggttcgacccc

SEQ ID NO: 137 - DNA, 336 bp, Artificial Sequence
  Description of Artificial Sequence: Synthetic light chain variable region
gatattgtgctgacccagtctccactctccctgcccgtcacccctggagagccggcctccatctcctgcaggtctagtcagagcctcctgcatagtcatggatacaactatttggattggtacttgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaaactctacaaactccgatcaccttcggccaagggacacgaatggagattaaa

SEQ ID NO: 138 - protein, 112 aa, Artificial Sequence
  Description of Artificial Sequence: Synthetic light chain variable region
DIVLTQSPLSLPVTPGEPASISCRSSQSLLHSHGYNYLDWYLQKPGQSPQLLIYLGSNRASGVPDRFSGSGSGTDFTLKISRVEAEDVGVYYCMQTLQTPITFGQGTRMEIK

SEQ ID NO: 139 - protein, 16 aa, Artificial Sequence
  Description of Artificial Sequence: Synthetic light chain variable region CDR L1
RSSQSLLHSHGYNYLD

SEQ ID NO: 140 - DNA, 48 bp, Artificial Sequence
  Description of Artificial Sequence: Synthetic light chain variable region CDR L1
aggtctagtcagagcctcctgcatagtcatggatacaactatttggat

SEQ ID NO: 141 - protein, 7 aa, Artificial Sequence
  Description of Artificial Sequence: Synthetic light chain variable region CDR L2
LGSNRAS

SEQ ID NO: 142 - DNA, 21 bp, Artificial Sequence
  Description of Artificial Sequence: Synthetic light chain variable region CDR L2
ttgggttctaatcgggcctcc

SEQ ID NO: 143 - protein, 9 aa, Artificial Sequence
  Description of Artificial Sequence: Synthetic light chain variable region CDR L3
MQTLQTPIT

SEQ ID NO: 144 - DNA, 27 bp, Artificial Sequence
  Description of Artificial Sequence: Synthetic light chain variable region CDR L3
atgcaaactctacaaactccgatcacc

SEQ ID NO: 145 - DNA, 378 bp, Artificial Sequence
  Description of Artificial Sequence: Synthetic heavy chain variable region
gaggtgcagctgcaggagtcgggcccaggactggtgaagcctttacagaccctgtccgtcacctgcagtgtctctggtggctccatcagcagtggtgataactactggagctggatccgccagcgcccagggaagggcctggagtggattgggtacatctattacagtgggaccacctactacaatccgtccctcaagagtcgagttaccatatcagcagacaggtctaagaatcagttttctctgaagatgaattctctgagtgccgcggacacggccgtgtattactgtgcgagagatggcggatatgatcacatctgggggactcatcgttatttcgccctctggggccagggaaccctggtcaccgtctcctca

SEQ ID NO: 146 - protein, 126 aa, Artificial Sequence
  Description of Artificial Sequence: Synthetic heavy chain variable region
EVQLQESGPGLVKPLQTLSVTCSVSGGSISSGDNYWSWIRQRPGKGLEWIGYIYYSGTTYYNPSLKSRVTISADRSKNQFSLKMNSLSAADTAVYYCARDGGYDHIWGTHRYFALWGQGTLVTVSS

SEQ ID NO: 147 - protein, 11 aa, Artificial Sequence
  Description of Artificial Sequence: Synthetic heavy chain variable region CDR H1
GSISSGDNYWS

SEQ ID NO: 148 - DNA, 33 bp, Artificial Sequence
  Description of Artificial Sequence: Synthetic heavy chain variable region CDR H1
ggctccatcagcagtggtgataactactggagc

SEQ ID NO: 149 - protein, 16 aa, Artificial Sequence
  Description of Artificial Sequence: Synthetic heavy chain variable region CDR H2
YIYYSGTTYYNPSLKS

SEQ ID NO: 150 - DNA, 48 bp, Artificial Sequence
  Description of Artificial Sequence: Synthetic heavy chain variable region CDR H2
tacatctattacagtgggaccacctactacaatccgtccctcaagagt

SEQ ID NO: 151 - protein, 18 aa, Artificial Sequence
  Description of Artificial Sequence: Synthetic heavy chain variable region CDR H3
ARDGGYDHIWGTHRYFAL

SEQ ID NO: 152 - DNA, 54 bp, Artificial Sequence
  Description of Artificial Sequence: Synthetic heavy chain variable region CDR H3
gcgagagatggcggatatgatcacatctgggggactcatcgttatttcgccctc

SEQ ID NO: 153 - DNA, 324 bp, Artificial Sequence
  Description of Artificial Sequence: Synthetic light chain variable region
gaaacgacactcacgcagtctccaggcaccctgtctttgtctccaggggaaagagccaccctctcctgcagggccagtcagagtgttaacagcgactacttggcctggtaccagcagaaacttggccaggctcccaggctcctcatttatggtgtatccaacagggccactggcatcccagacaggtttactgggagtgggtctgggacagacttcactctcaccatcagcagactggagcctgaagattttgcagtctatcactgtcagcagtatggtacctcaccgtggacgttcggccaagggaccaaggtggagatcaaa

SEQ ID NO: 154 - protein, 108 aa, Artificial Sequence
  Description of Artificial Sequence: Synthetic light chain variable region
ETTLTQSPGTLSLSPGERATLSCRASQSVNSDYLAWYQQKLGQAPRLLIYGVSNRATGIPDRFTGSGSGTDFTLTISRLEPEDFAVYHCQQYGTSPWTFGQGTKVEIK

SEQ ID NO: 155 - protein, 12 aa, Artificial Sequence
  Description of Artificial Sequence: Synthetic light chain variable region CDR L1
RASQSVNSDYLA

SEQ ID NO: 156 - DNA, 36 bp, Artificial Sequence
  Description of Artificial Sequence: Synthetic light chain variable region CDR L1
agggccagtcagagtgttaacagcgactacttggcc

SEQ ID NO: 157 - protein, 7 aa, Artificial Sequence
  Description of Artificial Sequence: Synthetic light chain variable region CDR L2
GVSNRAT

SEQ ID NO: 158 - DNA, 21 bp, Artificial Sequence
  Description of Artificial Sequence: Synthetic light chain variable region CDR L2
ggtgtatccaacagggccact

SEQ ID NO: 159 - protein, 9 aa, Artificial Sequence
  Description of Artificial Sequence: Synthetic light chain variable region CDR L3
QQYGTSPWT

SEQ ID NO: 160 - DNA, 27 bp, Artificial Sequence
  Description of Artificial Sequence: Synthetic light chain variable region CDR L3
cagcagtatggtacctcaccgtggacg

SEQ ID NO: 161 - DNA, 375 bp, Artificial Sequence
  Description of Artificial Sequence: Synthetic heavy chain variable region
caggtccagcttgtacagtctggggctgaggtgaagaggcctgggtcctcggtgaaagtctcctgtaaggcctctggaggcaccttcagtagttatgctctctcctgggtacggcaggcccctggacaaggacttgagtggataggggggatcatccctatgcatcgtgtaacaaattacgcacagaaatttcggggcagagtcacaatttccgcggacacatccacgagtacggcctacttggaggtgaacagcctgagagttgaggacacggccatgtattactgtgcgagagtgtttttcggaacttgtggcggtgcttcgtgcttcccctctgacctctggggccagggaaccctggtcactgtctcctca

SEQ ID NO: 162 - protein, 125 aa, Artificial Sequence
  Description of Artificial Sequence: Synthetic heavy chain variable region
QVQLVQSGAEVKRPGSSVKVSCKASGGTFSSYALSWVRQAPGQGLEWIGGIIPMHRVTNYAQKFRGRVTISADTSTSTAYLEVNSLRVEDTAMYYCARVFFGTCGGASCFPSDLWGQGTLVTVSS

SEQ ID NO: 163 - protein, 9 aa, Artificial Sequence
  Description of Artificial Sequence: Synthetic heavy chain variable region CDR H1
GTFSSYALS

SEQ ID NO: 164 - DNA, 27 bp, Artificial Sequence
  Description of Artificial Sequence: Synthetic heavy chain variable region CDR H1
ggcaccttcagtagttatgctctctcc

SEQ ID NO: 165 - protein, 17 aa, Artificial Sequence
  Description of Artificial Sequence: Synthetic heavy chain variable region CDR H2
GIIPMHRVTNYAQKFRG

SEQ ID NO: 166 - DNA, 51 bp, Artificial Sequence
  Description of Artificial Sequence: Synthetic heavy chain variable region CDR H2
gggatcatccctatgcatcgtgtaacaaattacgcacagaaatttcggggc

SEQ ID NO: 167 - protein, 18 aa, Artificial Sequence
  Description of Artificial Sequence: Synthetic heavy chain variable region CDR H3
ARVFFGTCGGASCFPSDL

SEQ ID NO: 168 - DNA, 54 bp, Artificial Sequence
  Description of Artificial Sequence: Synthetic heavy chain variable region CDR H3
gcgagagtgtttttcggaacttgtggcggtgcttcgtgcttcccctctgacctc

SEQ ID NO: 169 - DNA, 321 bp, Artificial Sequence
  Description of Artificial Sequence: Synthetic light chain variable region
gaaattgtgttgacacagtctccatccttcgtgtctgcttctgtcggagacggggtcaccatcacttgccgggccagtcaggccattagcagttatttagcctggtatcagcaaaaaccagggcaagcccctaaactcctgatctatgctgcatccactttgcaaggtggtgtcccatcaaggttcagcggcagtggatctgggacacatttcactctcaccatcagcagcctgcagcctgaagattttgcaacttattactgtcagcaacttcatagtgattttcagactttcggccctgggaccaaggtggaaatcaaa

SEQ ID NO: 170 - protein, 107 aa, Artificial Sequence
  Description of Artificial Sequence: Synthetic light chain variable region
EIVLTQSPSFVSASVGDGVTITCRASQAISSYLAWYQQKPGQAPKLLIYAASTLQGGVPSRFSGSGSGTHFTLTISSLQPEDFATYYCQQLHSDFQTFGPGTKVEIK

SEQ ID NO: 171 - protein, 11 aa, Artificial Sequence
  Description of Artificial Sequence: Synthetic light chain variable region CDR L1
RASQAISSYLA

SEQ ID NO: 172 - DNA, 33 bp, Artificial Sequence
  Description of Artificial Sequence: Synthetic light chain variable region CDR L1
cgggccagtcaggccattagcagttatttagcc

SEQ ID NO: 173 - protein, 7 aa, Artificial Sequence
  Description of Artificial Sequence: Synthetic light chain variable region CDR L2
AASTLQG

SEQ ID NO: 174 - DNA, 21 bp, Artificial Sequence
  Description of Artificial Sequence: Synthetic light chain variable region CDR L2
gctgcatccactttgcaaggt

SEQ ID NO: 175 - protein, 9 aa, Artificial Sequence
  Description of Artificial Sequence: Synthetic light chain variable region CDR L3
QQLHSDFQT

SEQ ID NO: 176 - DNA, 27 bp, Artificial Sequence
  Description of Artificial Sequence: Synthetic light chain variable region CDR L3
cagcaacttcatagtgattttcagact

SEQ ID NO: 177 - DNA, 360 bp, Artificial Sequence
  Description of Artificial Sequence: Synthetic heavy chain variable region
caggtgcagctggtggaatctgggggaggcgtggtccagcctgggaggtccctgagactctcctgtgtagcgtctggattcagcttcagtatgcatggcatgcactgggtccgccaggctccaggcaaggggctggagtgggtgacagctatatggtatgatggaagtaataaatattatgcagactccgtgaagggccgattcacgatctccagagacaattctaggaacacgctgtatctgcaaatgaacagcctgagagccgaggacacggctgtgtattactgtgcgagagatcatgcctcaactccatactacatggacgtctggggcaaagggaccacggtcaccgtctcctca

SEQ ID NO: 178 - protein, 120 aa, Artificial Sequence
  Description of Artificial Sequence: Synthetic heavy chain variable region
QVQLVESGGGVVQPGRSLRLSCVASGFSFSMHGMHWVRQAPGKGLEWVTAIWYDGSNKYYADSVKGRFTISRDNSRNTLYLQMNSLRAEDTAVYYCARDHASTPYYMDVWGKGTTVTVSS

SEQ ID NO: 179 - protein, 9 aa, Artificial Sequence
  Description of Artificial Sequence: Synthetic heavy chain variable region CDR H1
FSFSMHGMH

SEQ ID NO: 180 - DNA, 27 bp, Artificial Sequence
  Description of Artificial Sequence: Synthetic heavy chain variable region CDR H1
ttcagcttcagtatgcatggcatgcac

SEQ ID NO: 181 - protein, 17 aa, Artificial Sequence
  Description of Artificial Sequence: Synthetic heavy chain variable region CDR H2
AIWYDGSNKYYADSVKG

SEQ ID NO: 182 - DNA, 51 bp, Artificial Sequence
  Description of Artificial Sequence: Synthetic heavy chain variable region CDR H2
gctatatggtatgatggaagtaataaatattatgcagactccgtgaagggc

SEQ ID NO: 183 - protein, 13 aa, Artificial Sequence
  Description of Artificial Sequence: Synthetic heavy chain variable region CDR H3
ARDHASTPYYMDV

SEQ ID NO: 184 - DNA, 39 bp, Artificial Sequence
  Description of Artificial Sequence: Synthetic heavy chain variable region CDR H3
gcgagagatcatgcctcaactccatactacatggacgtc

SEQ ID NO: 185 - DNA, 324 bp, Artificial Sequence
  Description of Artificial Sequence: Synthetic light chain variable region
gaaacgacactcacgcagtctccaggcaccctgtctttgtctccaggggaaagcgccaccctctcctgcaggaccagtcagaggattagcagcacctacttagcctggtaccggcagaaacctggccaggctcccaggctcctcatgtatggtgcatccagcagggccactggcatcccggacaggttcagtggcagtgggtctgggacagacttcactctcaccatcagcagtctggagcctgaagattttgcactatattactgtcagcagtatggtagctttccgtggacgttcggccaagggaccaagctggagatcaaa

SEQ ID NO: 186 - protein, 108 aa, Artificial Sequence
  Description of Artificial Sequence: Synthetic light chain variable region
ETTLTQSPGTLSLSPGESATLSCRTSQRISSTYLAWYRQKPGQAPRLLMYGASSRATGIPDRFSGSGSGTDFTLTISSLEPEDFALYYCQQYGSFPWTFGQGTKLEIK

SEQ ID NO: 187 - protein, 12 aa, Artificial Sequence
  Description of Artificial Sequence: Synthetic light chain variable region CDR L1
RTSQRISSTYLA

SEQ ID NO: 188 - DNA, 36 bp, Artificial Sequence
  Description of Artificial Sequence: Synthetic light chain variable region CDR L1
aggaccagtcagaggattagcagcacctacttagcc

SEQ ID NO: 189 - protein, 7 aa, Artificial Sequence
  Description of Artificial Sequence: Synthetic light chain variable region CDR L2
GASSRAT

SEQ ID NO: 190 - DNA, 21 bp, Artificial Sequence
  Description of Artificial Sequence: Synthetic light chain variable region CDR L2
ggtgcatccagcagggccact

SEQ ID NO: 191 - protein, 9 aa, Artificial Sequence
  Description of Artificial Sequence: Synthetic light chain variable region CDR L3
QQYGSFPWT

SEQ ID NO: 192 - DNA, 27 bp, Artificial Sequence
  Description of Artificial Sequence: Synthetic light chain variable region CDR L3
cagcagtatggtagctttccgtggacg

SEQ ID NO: 193 - DNA, 378 bp, Artificial Sequence
  Description of Artificial Sequence: Synthetic heavy chain variable region
caggtgcagctacagcagtggggcgcaggactgtggaagccttcgcagaccctgtccctcacctgcgctgtccatggtggatccctcagtggctactcttggagttggatccgccagtccccagggaggggactggagtggatcggcgaagtcaatcgtaggggaaccaccaactacaacccctccctcaagggtcgagtctccatatcctgggacacgtccaagaaccaggtctccctgtccctgaggtctgtgaccgccgcggacacggctacatattactgtgcggggaccaatgttggattcgttaatacccataacgactactacttcggtatggacgtctggggccaagggaccacggtcaccgtctcctca

SEQ ID NO: 194 - protein, 126 aa, Artificial Sequence
  Description of Artificial Sequence: Synthetic heavy chain variable region
QVQLQQWGAGLWKPSQTLSLTCAVHGGSLSGYSWSWIRQSPGRGLEWIGEVNRRGTTNYNPSLKGRVSISWDTSKNQVSLSLRSVTAADTATYYCAGTNVGFVNTHNDYYFGMDVWGQGTTVTVSS

SEQ ID NO: 195 - protein, 9 aa, Artificial Sequence
  Description of Artificial Sequence: Synthetic heavy chain variable region CDR H1
GSLSGYSWS

SEQ ID NO: 196 - DNA, 27 bp, Artificial Sequence
  Description of Artificial Sequence: Synthetic heavy chain variable region CDR H1
ggatccctcagtggctactcttggagt

SEQ ID NO: 197 - protein, 16 aa, Artificial Sequence
  Description of Artificial Sequence: Synthetic heavy chain variable region CDR H2
EVNRRGTTNYNPSLKG

SEQ ID NO: 198 - DNA, 48 bp, Artificial Sequence
  Description of Artificial Sequence: Synthetic heavy chain variable region CDR H2
gaagtcaatcgtaggggaaccaccaactacaacccctccctcaagggt

SEQ ID NO: 199 - protein, 20 aa, Artificial Sequence
  Description of Artificial Sequence: Synthetic heavy chain variable region CDR H3
AGTNVGFVNTHNDYYFGMDV

SEQ ID NO: 200 - DNA, 60 bp, Artificial Sequence
  Description of Artificial Sequence: Synthetic heavy chain variable region CDR H3
gcggggaccaatgttggattcgttaatacccataacgactactacttcggtatggacgtc

SEQ ID NO: 201 - DNA, 321 bp, Artificial Sequence
  Description of Artificial Sequence: Synthetic light chain variable region
gatattgtgatgactcagtctccatcctccctgtctgcatcggttggagacagagtcaccatcacttgccgggcaagtcagagcataagcaattatgtaaattggtatcagaaaaaaacaggtcaagtccctaaactcctgatctatggtgcatccaatttggaaagtggggtcccatcaaggttcagtggcggtggatctgggacagatttcactctcaccatcagcagtctgcaacctgaagattttgcaacttattactgtcaacagagttacagtgtcccgctcactttcggcggagggaccaaggtggaaatcaaa

SEQ ID NO: 202 - protein, 107 aa, Artificial Sequence
  Description of Artificial Sequence: Synthetic light chain variable region
DIVMTQSPSSLSASVGDRVTITCRASQSISNYVNWYQKKTGQVPKLLIYGASNLESGVPSRFSGGGSGTDFTLTISSLQPEDFATYYCQQSYSVPLTFGGGTKVEIK

SEQ ID NO: 203 - protein, 11 aa, Artificial Sequence
  Description of Artificial Sequence: Synthetic light chain variable region CDR L1
RASQSISNYVN

SEQ ID NO: 204 - DNA, 33 bp, Artificial Sequence
  Description of Artificial Sequence: Synthetic light chain variable region CDR L1
cgggcaagtcagagcataagcaattatgtaaat

SEQ ID NO: 205 - protein, 7 aa, Artificial Sequence
  Description of Artificial Sequence: Synthetic light chain variable region CDR L2
GASNLES

SEQ ID NO: 206 - DNA, 21 bp, Artificial Sequence
  Description of Artificial Sequence: Synthetic light chain variable region CDR L2
ggtgcatccaatttggaaagt

SEQ ID NO: 207 - protein, 9 aa, Artificial Sequence
  Description of Artificial Sequence: Synthetic light chain variable region CDR L3
QQSYSVPLT

SEQ ID NO: 208 - DNA, 27 bp, Artificial Sequence
  Description of Artificial Sequence: Synthetic light chain variable region CDR L3
caacagagttacagtgtcccgctcact

SEQ ID NO: 209 - DNA, 375 bp, Artificial Sequence
  Description of Artificial Sequence: Synthetic heavy chain variable region
caggtccagcttgtacagtctggggctgaggtgaagaggcctggatcctcggtgaaggtctcctgcaaggcgtctggaggcaccttccgcggctaccatatcagctggctgcgccaggcccctggacagggcctcgagtggctgggagggatcacccatttgtttgggacagttagttacgctccgaagttccagggcagagtcaccatcaccgcggacgcatccacgggcacactttacatggtgttgaacagcctgaaacctgaggacacggccatttattattgtgcgagagatgcttacgaggtgtggactggttcttatctccccccttttgactactggggccagggaaccctggtcaccgtctcctca

SEQ ID NO: 210 - protein, 125 aa, Artificial Sequence
  Description of Artificial Sequence: Synthetic heavy chain variable region
QVQLVQSGAEVKRPGSSVKVSCKASGGTFRGYHISWLRQAPGQGLEWLGGITHLFGTVSYAPKFQGRVTITADASTGTLYMVLNSLKPEDTAIYYCARDAYEVWTGSYLPPFDYWGQGTLVTVSS

SEQ ID NO: 211 - protein, 9 aa, Artificial Sequence
  Description of Artificial Sequence: Synthetic heavy chain variable region CDR H1
GTFRGYHIS

SEQ ID NO: 212 - DNA, 27 bp, Artificial Sequence
  Description of Artificial Sequence: Synthetic heavy chain variable region CDR H1
ggcaccttccgcggctaccatatcagc

SEQ ID NO: 213 - protein, 17 aa, Artificial Sequence
  Description of Artificial Sequence: Synthetic heavy chain variable region CDR H2
GITHLFGTVSYAPKFQG

SEQ ID NO: 214 - DNA, 51 bp, Artificial Sequence
  Description of Artificial Sequence: Synthetic heavy chain variable region CDR H2
gggatcacccatttgtttgggacagttagttacgctccgaagttccagggc

SEQ ID NO: 215 - protein, 18 aa, Artificial Sequence
  Description of Artificial Sequence: Synthetic heavy chain variable region CDR H3
ARDAYEVWTGSYLPPFDY

SEQ ID NO: 216 - DNA, 54 bp, Artificial Sequence
  Description of Artificial Sequence: Synthetic heavy chain variable region CDR H3
gcgagagatgcttacgaggtgtggactggttcttatctccccccttttgactac

SEQ ID NO: 217 - DNA, 324 bp, Artificial Sequence
  Description of Artificial Sequence: Synthetic light chain variable region
gaaacgacactcacgcagtctccaggcaccctgtctttgtctcccggggaaagagccaccctctcttgcagggccagtcagactgttacaagcaactacttagcctggtaccagcagaaacctggccaggctcccaggctcctcatctatgatgcactcaccagggccactggcatcccagacaggttcagtggcagtgggtctgggacagacttcactctcaccatcagcagactggagcctgaagattttgcactttattattgtcagcagtatggtagttcattcctcactttcggcggagggaccaaagtggatatcaaa

SEQ ID NO: 218 - protein, 108 aa, Artificial Sequence
  Description of Artificial Sequence: Synthetic light chain variable region
ETTLTQSPGTLSLSPGERATLSCRASQTVTSNYLAWYQQKPGQAPRLLIYDALTRATGIPDRFSGSGSGTDFTLTISRLEPEDFALYYCQQYGSSFLTFGGGTKVDIK

SEQ ID NO: 219 - protein, 12 aa, Artificial Sequence
  Description of Artificial Sequence: Synthetic light chain variable region CDR L1
RASQTVTSNYLA

SEQ ID NO: 220 - DNA, 36 bp, Artificial Sequence
  Description of Artificial Sequence: Synthetic light chain variable region CDR L1
agggccagtcagactgttacaagcaactacttagcc

SEQ ID NO: 221 - protein, 7 aa, Artificial Sequence
  Description of Artificial Sequence: Synthetic light chain variable region CDR L2
DALTRAT

SEQ ID NO: 222 - DNA, 21 bp, Artificial Sequence
  Description of Artificial Sequence: Synthetic light chain variable region CDR L2
gatgcactcaccagggccact

SEQ ID NO: 223 - protein, 9 aa, Artificial Sequence
  Description of Artificial Sequence: Synthetic light chain variable region CDR L3
QQYGSSFLT

SEQ ID NO: 224 - DNA, 27 bp, Artificial Sequence
  Description of Artificial Sequence: Synthetic light chain variable region CDR L3
cagcagtatggtagttcattcctcact

SEQ ID NO: 225 - DNA, 375 bp, Artificial Sequence
  Description of Artificial Sequence: Synthetic heavy chain variable region
caggtgcagctgcaggagtccggggctgaggtgaagaagcctgggtcctcggtgaaggtctcctgcaaggcttctggaggcgccttcagcagctatgctatcagctgggtgcgacaggcccctggacagggcctcgagtggctgggagggatcacccatttgtttgggacagttagttacgctccgaagttccagggcagagtcaccatcaccgcggacgcatccacgggcacactttacatggtgttgaacagcctgaaacctgaggacacggccatttattattgtgcgagagatgcttacgaggtgtggactggttcttatctccccccttttgactactggggccagggaaccctggtcaccgtctcctca

SEQ ID NO: 226 - protein, 125 aa, Artificial Sequence
  Description of Artificial Sequence: Synthetic heavy chain variable region
QVQLQESGAEVKKPGSSVKVSCKASGGAFSSYAISWVRQAPGQGLEWLGGITHLFGTVSYAPKFQGRVTITADASTGTLYMVLNSLKPEDTAIYYCARDAYEVWTGSYLPPFDYWGQGTLVTVSS

SEQ ID NO: 227 - protein, 9 aa, Artificial Sequence
  Description of Artificial Sequence: Synthetic heavy chain variable region CDR H1
GAFSSYAIS

SEQ ID NO: 228 - DNA, 27 bp, Artificial Sequence
  Description of Artificial Sequence: Synthetic heavy chain variable region CDR H1
ggcgccttcagcagctatgctatcagc

SEQ ID NO: 229 - protein, 17 aa, Artificial Sequence
  Description of Artificial Sequence: Synthetic heavy chain variable region CDR H2
GITHLFGTVSYAPKFQG

SEQ ID NO: 230 - DNA, 51 bp, Artificial Sequence; identical to SEQ ID NO: 214
  Description of Artificial Sequence: Synthetic heavy chain variable region CDR H2

SEQ ID NO: 231 - protein, 18 aa, Artificial Sequence
  Description of Artificial Sequence: Synthetic heavy chain variable region CDR H3
ARDAYEVWTGSYLPPFDY

SEQ ID NO: 232 - DNA, 54 bp, Artificial Sequence; identical to SEQ ID NO: 216
  Description of Artificial Sequence: Synthetic heavy chain variable region CDR H3

SEQ ID NO: 233 - DNA, 324 bp, Artificial Sequence
  Description of Artificial Sequence: Synthetic light chain variable region
gaaattgtattgacacagtctccaggcaccctgtctttgtctcccggggaaagagccaccctctcttgcagggccagtcagactgttacaagcaactacttagcctggtaccagcagaaacctggccaggctcccaggctcctcatctatgatgcactcaccagggccactggcatcccagacaggttcagtggcagtgggtctgggacagacttcactctcaccatcagcagactggagcctgaagattttgcactttattattgtcagcagtatggtagttcattcctcactttcggcggagggaccaagctggagatcaaa

SEQ ID NO: 234 - protein, 108 aa, Artificial Sequence
  Description of Artificial Sequence: Synthetic light chain variable region
EIVLTQSPGTLSLSPGERATLSCRASQTVTSNYLAWYQQKPGQAPRLLIYDALTRATGIPDRFSGSGSGTDFTLTISRLEPEDFALYYCQQYGSSFLTFGGGTKLEIK

SEQ ID NO: 235 - protein, 12 aa, Artificial Sequence
  Description of Artificial Sequence: Synthetic light chain variable region CDR L1
RASQTVTSNYLA

SEQ ID NO: 236 - DNA, 36 bp, Artificial Sequence; identical to SEQ ID NO: 220
  Description of Artificial Sequence: Synthetic light chain variable region CDR L1

SEQ ID NO: 237 - protein, 7 aa, Artificial Sequence
  Description of Artificial Sequence: Synthetic light chain variable region CDR L2
DALTRAT

SEQ ID NO: 238 - DNA, 21 bp, Artificial Sequence
  Description of Artificial Sequence: Synthetic light chain variable region CDR L2
gatgcactcaccagggccact

SEQ ID NO: 239 - protein, 9 aa, Artificial Sequence
  Description of Artificial Sequence: Synthetic light chain variable region CDR L3
QQYGSSFLT

SEQ ID NO: 240 - DNA, 27 bp, Artificial Sequence
  Description of Artificial Sequence: Synthetic light chain variable region CDR L3
cagcagtatggtagttcattcctcact

SEQ ID NO: 241 - DNA, 366 bp, Artificial Sequence
  Description of Artificial Sequence: Synthetic heavy chain variable region
caggtccagctggtacagtctggagctgaggtgaaggagcctggggcctcagtgagggtctcctgcaaggcttctggttacacctttaccagctatggtatcagctgggtgcgacaggcccctggacaagggcttgagtggatgggatggatcagcgcttacaatggtaacacaaactatgcacagaagttccagggcagagtcaccgtgaccacagacacatccacgagcgcagcctacatggagctgaggagcctgagatctgacgacacggccatttattactgtgcgagagattcattttcactgactggtgctggatttcctgactactggggccagggaaccctggtcaccgtctcctca

SEQ ID NO: 242 - protein, 122 aa, Artificial Sequence
  Description of Artificial Sequence: Synthetic heavy chain variable region
QVQLVQSGAEVKEPGASVRVSCKASGYTFTSYGISWVRQAPGQGLEWMGWISAYNGNTNYAQKFQGRVTVTTDTSTSAAYMELRSLRSDDTAIYYCARDSFSLTGAGFPDYWGQGTLVTVSS

SEQ ID NO: 243 - protein, 9 aa, Artificial Sequence
  Description of Artificial Sequence: Synthetic heavy chain variable region CDR H1
YTFTSYGIS

SEQ ID NO: 244 - DNA, 27 bp, Artificial Sequence
  Description of Artificial Sequence: Synthetic heavy chain variable region CDR H1
tacacctttaccagctatggtatcagc

SEQ ID NO: 245 - protein, 17 aa, Artificial Sequence
  Description of Artificial Sequence: Synthetic heavy chain variable region CDR H2
WISAYNGNTNYAQKFQG

SEQ ID NO: 246 - DNA, 51 bp, Artificial Sequence; identical to SEQ ID NO: 86
  Description of Artificial Sequence: Synthetic heavy chain variable region CDR H2

SEQ ID NO: 247 - protein, 15 aa, Artificial Sequence
  Description of Artificial Sequence: Synthetic heavy chain variable region CDR H3
ARDSFSLTGAGFPDY

SEQ ID NO: 248 - DNA, 45 bp, Artificial Sequence
  Description of Artificial Sequence: Synthetic heavy chain variable region CDR H3
gcgagagattcattttcactgactggtgctggatttcctgactac

SEQ ID NO: 249 - DNA, 336 bp, Artificial Sequence
  Description of Artificial Sequence: Synthetic light chain variable region
gaaattgtaatgacgcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcagacactgatttcacactgaaaatcagcagggtggaggctgaggatgttggggtttattactgcatgcaagctacacagtggcctcgcacgttcggccaagggaccaaggtggaaatcaaa

SEQ ID NO: 250 - protein, 112 aa, Artificial Sequence
  Description of Artificial Sequence: Synthetic light chain variable region
EIVMTQSPLSLPVTLGQPASISCRSSQSLVYSDGNTYLNWFQQRPGQSPRRLIYKVSNRDSGVPDRFSGSGSDTDFTLKISRVEAEDVGVYYCMQATQWPRTFGQGTKVEIK

SEQ ID NO: 251 - protein, 16 aa, Artificial Sequence
  Description of Artificial Sequence: Synthetic light chain variable region CDR L1
RSSQSLVYSDGNTYLN

SEQ ID NO: 252 - DNA, 48 bp, Artificial Sequence
  Description of Artificial Sequence: Synthetic light chain variable region CDR L1
aggtctagtcaaagcctcgtatacagtgatggaaacacctacttgaat

SEQ ID NO: 253 - protein, 7 aa, Artificial Sequence
  Description of Artificial Sequence: Synthetic light chain variable region CDR L2
KVSNRDS

SEQ ID NO: 254 - DNA, 21 bp, Artificial Sequence
  Description of Artificial Sequence: Synthetic light chain variable region CDR L2
aaggtttctaaccgggactct

SEQ ID NO: 255 - protein, 9 aa, Artificial Sequence
  Description of Artificial Sequence: Synthetic light chain variable region CDR L3
MQATQWPRT

SEQ ID NO: 256 - DNA, 27 bp, Artificial Sequence
  Description of Artificial Sequence: Synthetic light chain variable region CDR L3
atgcaagctacacagtggcctcgcacg

SEQ ID NO: 257 - DNA, 360 bp, Artificial Sequence
  Description of Artificial Sequence: Synthetic heavy chain variable region
gaggtgcagctgttggagtctgggggaggcctggtcaagcctggggggtccctgagactctcctgtgtagcctctggattcaccttcagtagctataacatcaactgggtccgccaggctccagggaagggactggagtgggtctcatccattagtggtggtagtaattacatagactacgcagactcagtgaagggccgattcaccatctccagagacaacgccaagaactcactgtatttgcaaatgaacaacctgcgagccgaagacacggctgtgtattactgtgcgagacttggctatggtggtaacccggagcttgactattggggccagggaaccctggtcactgtctcctca

SEQ ID NO: 258 - protein, 120 aa, Artificial Sequence
  Description of Artificial Sequence: Synthetic heavy chain variable region
EVQLLESGGGLVKPGGSLRLSCVASGFTFSSYNINWVRQAPGKGLEWVSSISGGSNYIDYADSVKGRFTISRDNAKNSLYLQMNNLRAEDTAVYYCARLGYGGNPELDYWGQGTLVTVSS

SEQ ID NO: 259 - protein, 9 aa, Artificial Sequence
  Description of Artificial Sequence: Synthetic heavy chain variable region CDR H1
FTFSSYNIN

SEQ ID NO: 260 - DNA, 27 bp, Artificial Sequence
  Description of Artificial Sequence: Synthetic heavy chain variable region CDR H1
ttcaccttcagtagctataacatcaac

SEQ ID NO: 261 - protein, 17 aa, Artificial Sequence
  Description of Artificial Sequence: Synthetic heavy chain variable region CDR H2
SISGGSNYIDYADSVKG

SEQ ID NO: 262 - DNA, 51 bp, Artificial Sequence
  Description of Artificial Sequence: Synthetic heavy chain variable region CDR H2
tccattagtggtggtagtaattacatagactacgcagactcagtgaagggc

SEQ ID NO: 263 - protein, 13 aa, Artificial Sequence
  Description of Artificial Sequence: Synthetic heavy chain variable region CDR H3
ARLGYGGNPELDY

SEQ ID NO: 264 - DNA, 39 bp, Artificial Sequence
  Description of Artificial Sequence: Synthetic heavy chain variable region CDR H3
gcgagacttggctatggtggtaacccggagcttgactat

SEQ ID NO: 265 - DNA, 336 bp, Artificial Sequence
  Description of Artificial Sequence: Synthetic light chain variable region
cagtctgtgctgacgcagccgccctcagtgtctggggccccaggacagagggtcaccatctcctgcaccgggagcagctccaacatcggggcaggttatgatgtacactggtaccagcaacgtccaggaacagcccccaaactcctcatctatgctaataacaatcggccctcaggggtccctgaccgattctctggctccaagtctggcacctcagcctccctggccatcactgggctccaggctgaggatgaggctgattattactgccagtcctatgacctcagtctgagtagttcgagggtattcggcggagggaccaagctgaccgtcctc

SEQ ID NO: 266 - protein, 112 aa, Artificial Sequence
  Description of Artificial Sequence: Synthetic light chain variable region
QSVLTQPPSVSGAPGQRVTISCTGSSSNIGAGYDVHWYQQRPGTAPKLLIYANNNRPSGVPDRFSGSKSGTSASLAITGLQAEDEADYYCQSYDLSLSSSRVFGGGTKLTVL

SEQ ID NO: 267 - protein, 14 aa, Artificial Sequence
  Description of Artificial Sequence: Synthetic light chain variable region CDR L1
TGSSSNIGAGYDVH

SEQ ID NO: 268 - DNA, 42 bp, Artificial Sequence
  Description of Artificial Sequence: Synthetic light chain variable region CDR L1
accgggagcagctccaacatcggggcaggttatgatgtacac

SEQ ID NO: 269 - protein, 7 aa, Artificial Sequence
  Description of Artificial Sequence: Synthetic light chain variable region CDR L2
ANNNRPS

SEQ ID NO: 270 - DNA, 21 bp, Artificial Sequence
  Description of Artificial Sequence: Synthetic light chain variable region CDR L2
gctaataacaatcggccctca

SEQ ID NO: 271 - protein, 12 aa, Artificial Sequence
  Description of Artificial Sequence: Synthetic light chain variable region CDR L3
QSYDLSLSSSRV

SEQ ID NO: 272 - DNA, 36 bp, Artificial Sequence
  Description of Artificial Sequence: Synthetic light chain variable region CDR L3
cagtcctatgacctcagtctgagtagttcgagggta

SEQ ID NO: 273 - DNA, 366 bp, Artificial Sequence
  Description of Artificial Sequence: Synthetic heavy chain variable region
caggtccagctggtgcagtctgggggaggcgtggtccagcctgggaggtccctgaaacactcatgtgcagcctctggattcaccttcaataactatgctatacactgggtccgccaggctccaggcaagggcctggagtgggtggcagctatctcatatgatggaagcaatgaatactactcaaactccgtgaagggccgattcaccatctccagagacaattccaagtacacgctgtatctgcaaatgaacagcctgagacctgaggacacggctgtgtattactgtgcgagaggcgcctcctattactatgtgagtagtgaccttggctactggggccagggaaccctggtcaccgtctcctca

SEQ ID NO: 274 - protein, 122 aa, Artificial Sequence
  Description of Artificial Sequence: Synthetic heavy chain variable region
QVQLVQSGGGVVQPGRSLKHSCAASGFTFNNYAIHWVRQAPGKGLEWVAAISYDGSNEYYSNSVKGRFTISRDNSKYTLYLQMNSLRPEDTAVYYCARGASYYYVSSDLGYWGQGTLVTVSS

SEQ ID NO: 275 - protein, 9 aa, Artificial Sequence
  Description of Artificial Sequence: Synthetic heavy chain variable region CDR H1
FTFNNYAIH

SEQ ID NO: 276 - DNA, 27 bp, Artificial Sequence
  Description of Artificial Sequence: Synthetic heavy chain variable region CDR H1
ttcaccttcaataactatgctatacac

SEQ ID NO: 277 - protein, 17 aa, Artificial Sequence
  Description of Artificial Sequence: Synthetic heavy chain variable region CDR H2
AISYDGSNEYYSNSVKG

SEQ ID NO: 278 - DNA, 51 bp, Artificial Sequence
  Description of Artificial Sequence: Synthetic heavy chain variable region CDR H2
gctatctcatatgatggaagcaatgaatactactcaaactccgtgaagggc

SEQ ID NO: 279 - protein, 15 aa, Artificial Sequence
  Description of Artificial Sequence: Synthetic heavy chain variable region CDR H3
ARGASYYYVSSDLGY

SEQ ID NO: 280 - DNA, 45 bp, Artificial Sequence
  Description of Artificial Sequence: Synthetic heavy chain variable region CDR H3
gcgagaggcgcctcctattactatgtgagtagtgaccttggctac

SEQ ID NO: 281 - DNA, 333 bp, Artificial Sequence
  Description of Artificial Sequence: Synthetic light chain variable region
cagcctgtgctgactcagccgccctcagtgtctggggccccagggcagagggtcaccatctcctgcactgggagcagctccaacatcgggtcaggttatgatgtgcactggtatcagcagcttccaggaacagcccccaaagtcgtcatctatggtaacatcaatcggccctcaggggtccctgagcgattctctggctccaagtctggcacctcagcctccctggccatcactgggctccaggctgaggatgaggctgattattactgccagtcctatgacagcctgagtgcctcttgggtgttcggcggagggaccaagctcaccgtccta

SEQ ID NO: 282 - protein, 111 aa, Artificial Sequence
  Description of Artificial Sequence: Synthetic light chain variable region
QPVLTQPPSVSGAPGQRVTISCTGSSSNIGSGYDVHWYQQLPGTAPKVVIYGNINRPSGVPERFSGSKSGTSASLAITGLQAEDEADYYCQSYDSLSASWVFGGGTKLTVL

SEQ ID NO: 283 - protein, 14 aa, Artificial Sequence
  Description of Artificial Sequence: Synthetic light chain variable region CDR L1
TGSSSNIGSGYDVH

SEQ ID NO: 284 - DNA, 42 bp, Artificial Sequence
  Description of Artificial Sequence: Synthetic light chain variable region CDR L1
actgggagcagctccaacatcgggtcaggttatgatgtgcac

SEQ ID NO: 285 - protein, 7 aa, Artificial Sequence
  Description of Artificial Sequence: Synthetic light chain variable region CDR L2
GNINRPS

SEQ ID NO: 286 - DNA, 21 bp, Artificial Sequence
  Description of Artificial Sequence: Synthetic light chain variable region CDR L2
ggtaacatcaatcggccctca

SEQ ID NO: 287 - protein, 11 aa, Artificial Sequence
  Description of Artificial Sequence: Synthetic light chain variable region CDR L3
QSYDSLSASWV

SEQ ID NO: 288 - DNA, 33 bp, Artificial Sequence
  Description of Artificial Sequence: Synthetic light chain variable region CDR L3
cagtcctatgacagcctgagtgcctcttgggtg

SEQ ID NO: 289 - DNA, 348 bp, Artificial Sequence
  Description of Artificial Sequence: Synthetic heavy chain variable region
caggtccagcttgtgcagtctggaccagaggtgaaaaagaccagagagtctctgaagatctactgtaagggttctggatacagctttatcagccactggatcggctgggtgcgccagaaacccgggaaaggcctggagtggatggggatcatctatccgggtgactctgacaccagatacagcccgtccttccaaggccaggtcgccatctcagccgacaagtccatcaacaccgcctacctgcagtggagcagcctgaagtcctcggacaccgccatatattactgtgcgagtgtaatgcttcgggggattatgtggggccagggaaccctggtcaccgtctcctca

SEQ ID NO: 290 - protein, 116 aa, Artificial Sequence
  Description of Artificial Sequence: Synthetic heavy chain variable region
QVQLVQSGPEVKKTRESLKIYCKGSGYSFISHWIGWVRQKPGKGLEWMGIIYPGDSDTRYSPSFQGQVAISADKSINTAYLQWSSLKSSDTAIYYCASVMLRGIMWGQGTLVTVSS

SEQ ID NO: 291 - protein, 9 aa, Artificial Sequence
  Description of Artificial Sequence: Synthetic heavy chain variable region CDR H1
YSFISHWIG

SEQ ID NO: 292 - DNA, 27 bp, Artificial Sequence
  Description of Artificial Sequence: Synthetic heavy chain variable region CDR H1
tacagctttatcagccactggatcggc

SEQ ID NO: 293 - protein, 17 aa, Artificial Sequence
  Description of Artificial Sequence: Synthetic heavy chain variable region CDR H2
IIYPGDSDTRYSPSFQG

SEQ ID NO: 294 - DNA, 51 bp, Artificial Sequence
  Description of Artificial Sequence: Synthetic heavy chain variable region CDR H2
atcatctatccgggtgactctgacaccagatacagcccgtccttccaaggc

SEQ ID NO: 295 - protein, 9 aa, Artificial Sequence
  Description of Artificial Sequence: Synthetic heavy chain variable region CDR H3
ASVMLRGIM

SEQ ID NO: 296 - DNA, 27 bp, Artificial Sequence
  Description of Artificial Sequence: Synthetic heavy chain variable region CDR H3
gcgagtgtaatgcttcgggggattatg

SEQ ID NO: 297 - DNA, 327 bp, Artificial Sequence
  Description of Artificial Sequence: Synthetic light chain variable region
gacatccggttgacccagtctccatcctccctgtctgcatctgtaggagacagagtcaccatcacttgccaggcgagtcaggacattagcaagtatctaaattggtatcagcagaaaccagggaaagcccctaagctcctgatctacgatgcatccaatttggaaacaggggtcccatcaagattcagtggaagtggatctgggacagattttactttcaccatcagcagcctgcagcctgaagatattgcaacatattactgtcagccgtatgataatctccctccgccgctcactttcggcggagggaccaagctggagatcaaa

SEQ ID NO: 298 - protein, 109 aa, Artificial Sequence
  Description of Artificial Sequence: Synthetic light chain variable region
DIRLTQSPSSLSASVGDRVTITCQASQDISKYLNWYQQKPGKAPKLLIYDASNLETGVPSRFSGSGSGTDFTFTISSLQPEDIATYYCQPYDNLPPPLTFGGGTKLEIK

SEQ ID NO: 299 - protein, 11 aa, Artificial Sequence
  Description of Artificial Sequence: Synthetic light chain variable region CDR L1
QASQDISKYLN

SEQ ID NO: 300 - DNA, 33 bp, Artificial Sequence
  Description of Artificial Sequence: Synthetic light chain variable region CDR L1
caggcgagtcaggacattagcaagtatctaaat

SEQ ID NO: 301 - protein, 7 aa, Artificial Sequence
  Description of Artificial Sequence: Synthetic light chain variable region CDR L2
DASNLET

SEQ ID NO: 302 - DNA, 21 bp, Artificial Sequence
  Description of Artificial Sequence: Synthetic light chain variable region CDR L2
gatgcatccaatttggaaaca

SEQ ID NO: 303 - protein, 11 aa, Artificial Sequence
  Description of Artificial Sequence: Synthetic light chain variable region CDR L3
QPYDNLPPPLT

SEQ ID NO: 304 - DNA, 33 bp, Artificial Sequence
  Description of Artificial Sequence: Synthetic light chain variable region CDR L3
cagccgtatgataatctccctccgccgctcact

SEQ ID NO: 305 - DNA, 366 bp, Artificial Sequence
  Description of Artificial Sequence: Synthetic heavy chain variable region
gaggtgcagctgttggagtctgggggaggcgtggtccagtctgggaggtccctgagactctcctgtgcagcgtctggattcaccttcagtgacaatggcatgcactgggtccgccaggctccaggcaaggggctggagtgggtggcaggtatattttatgatggaagtaataaacaatatgcagactccgtgaagggccgattcaccatctccagagacaattccaagagcacgctgtatctgcaaatgaacagcctgagagccgaggacacggctgtgtattactgtgcgagagccccttacgatatttggagtggttattgtcttgactactggggccagggaaccctggtcaccgtctcctca

SEQ ID NO: 306 - protein, 122 aa, Artificial Sequence
  Description of Artificial Sequence: Synthetic heavy chain variable region
EVQLLESGGGVVQSGRSLRLSCAASGFTFSDNGMHWVRQAPGKGLEWVAGIFYDGSNKQYADSVKGRFTISRDNSKSTLYLQMNSLRAEDTAVYYCARAPYDIWSGYCLDYWGQGTLVTVSS

SEQ ID NO: 307 - protein, 9 aa, Artificial Sequence
  Description of Artificial Sequence: Synthetic heavy chain variable region CDR H1
FTFSDNGMH

SEQ ID NO: 308 - DNA, 27 bp, Artificial Sequence
  Description of Artificial Sequence: Synthetic heavy chain variable region CDR H1
ttcaccttcagtgacaatggcatgcac

SEQ ID NO: 309 - protein, 17 aa, Artificial Sequence
  Description of Artificial Sequence: Synthetic heavy chain variable region CDR H2
GIFYDGSNKQYADSVKG

SEQ ID NO: 310 - DNA, 51 bp, Artificial Sequence
  Description of Artificial Sequence: Synthetic heavy chain variable region CDR H2
ggtatattttatgatggaagtaataaacaatatgcagactccgtgaagggc

SEQ ID NO: 311 - protein, 15 aa, Artificial Sequence
  Description of Artificial Sequence: Synthetic heavy chain variable region CDR H3
ARAPYDIWSGYCLDY

SEQ ID NO: 312 - DNA, 45 bp, Artificial Sequence
  Description of Artificial Sequence: Synthetic heavy chain variable region CDR H3
gcgagagccccttacgatatttggagtggttattgtcttgactac

SEQ ID NO: 313 - DNA, 321 bp, Artificial Sequence
  Description of Artificial Sequence: Synthetic light chain variable region
gacatccagatgactcagactccagccaccctgtctatgtctccaggggaaagagccaccctctcctgcagggccagtcagagtgttaacaacaacttagcctggtaccagcagagacctggccaggctcccaggctcctcatctatggtgcatctaccagggccactggtatcccagccaggttcagtggcagtgggtctgagacagagttcactctcactatcagcagcctgcagtctgaagattttgcggtttatcactgtcagcagtatagtatctggcctcagacttttggccaggggaccaagctggagatcaaa

SEQ ID NO: 314 - protein, 107 aa, Artificial Sequence
  Description of Artificial Sequence: Synthetic light chain variable region
DIQMTQTPATLSMSPGERATLSCRASQSVNNNLAWYQQRPGQAPRLLIYGASTRATGIPARFSGSGSETEFTLTISSLQSEDFAVYHCQQYSIWPQTFGQGTKLEIK

SEQ ID NO: 315 - protein, 11 aa, Artificial Sequence
  Description of Artificial Sequence: Synthetic light chain variable region CDR L1
RASQSVNNNLA

SEQ ID NO: 316 - DNA, 33 bp, Artificial Sequence
  Description of Artificial Sequence: Synthetic light chain variable region CDR L1
agggccagtcagagtgttaacaacaacttagcc

SEQ ID NO: 317 - protein, 7 aa, Artificial Sequence
  Description of Artificial Sequence: Synthetic light chain variable region CDR L2
GASTRAT

SEQ ID NO: 318 - DNA, 21 bp, Artificial Sequence
  Description of Artificial Sequence: Synthetic light chain variable region CDR L2
ggtgcatctaccagggccact

SEQ ID NO: 319 - protein, 9 aa, Artificial Sequence
  Description of Artificial Sequence: Synthetic light chain variable region CDR L3
QQYSIWPQT

SEQ ID NO: 320 - DNA, 27 bp, Artificial Sequence
  Description of Artificial Sequence: Synthetic light chain variable region CDR L3
cagcagtatagtatctggcctcagact

SEQ ID NO: 321 - DNA, 384 bp, Artificial Sequence
  Description of Artificial Sequence: Synthetic heavy chain variable region
gaggtgcagctggtggagtctgggggaggcttggtccagcctggggggtccctgagactctcctgtgcagcctctggattcactattggaacgtactggatgagctgggtccgccaggctccagggaaggggctggagtgggtggccaacataaaaccagatggaagtgagcaatattatggggactcggtgaagggccgattcaccatctccagagacaacgccaagaattccctgtatctgcaaatgcacagcctgagagccgaggacgcggctgtcttttactgtgcgagggatactcccgacgtattacgacatttggagtggccccctgtaggtgcttttgatatctggggccaagggaccacggtcaccgtctcctca

SEQ ID NO: 322 - protein, 128 aa, Artificial Sequence
  Description of Artificial Sequence: Synthetic heavy chain variable region
EVQLVESGGGLVQPGGSLRLSCAASGFTIGTYWMSWVRQAPGKGLEWVANIKPDGSEQYYGDSVKGRFTISRDNAKNSLYLQMHSLRAEDAAVFYCARDTPDVLRHLEWPPVGAFDIWGQGTTVTVSS

SEQ ID NO: 323 - protein, 9 aa, Artificial Sequence
  Description of Artificial Sequence: Synthetic heavy chain variable region CDR H1
FTIGTYWMS

SEQ ID NO: 324 - DNA, 27 bp, Artificial Sequence
  Description of Artificial Sequence: Synthetic heavy chain variable region CDR H1
ttcactattggaacgtactggatgagc

SEQ ID NO: 325 - protein, 17 aa, Artificial Sequence
  Description of Artificial Sequence: Synthetic heavy chain variable region CDR H2
NIKPDGSEQYYGDSVKG

SEQ ID NO: 326 - DNA, 51 bp, Artificial Sequence
  Description of Artificial Sequence: Synthetic heavy chain variable region CDR H2
aacataaaaccagatggaagtgagcaatattatggggactcggtgaagggc

SEQ ID NO: 327 - protein, 21 aa, Artificial Sequence
  Description of Artificial Sequence: Synthetic heavy chain variable region CDR H3
ARDTPDVLRHLEWPPVGAFDI

SEQ ID NO: 328 - DNA, 63 bp, Artificial Sequence
  Description of Artificial Sequence: Synthetic heavy chain variable region CDR H3
gcgagggatactcccgacgtattacgacatttggagtggccccctgtaggtgcttttgatatc

SEQ ID NO: 329 - DNA, 339 bp, Artificial Sequence
  Description of Artificial Sequence: Synthetic light chain variable region
gaaattgtaatgacgcagtctccagactccctggctgtgtctctgggcgagagggccaccatcaactgcaagtccagccagagtcttttctacagctccaccaatcagcactacttggcttggtaccagcagaaaccaggacagcctcctgagctgctcatttactgggcatctatccgggaatccggggtccctgaccgattcagtggcagcgggtctgggacagatttcactctcaccatcagcagcctgcaggccgcagatgtggcagtttattactgtcagcagtattatagtagtcctcaaacttttggccaggggaccaaggtggaaatcaaa

SEQ ID NO: 330 - protein, 113 aa, Artificial Sequence
  Description of Artificial Sequence: Synthetic light chain variable region
EIVMTQSPDSLAVSLGERATINCKSSQSLFYSSTNQHYLAWYQQKPGQPPELLIYWASIRESGVPDRFSGSGSGTDFTLTISSLQAADVAVYYCQQYYSSPQTFGQGTKVEIK

SEQ ID NO: 331 - protein, 17 aa, Artificial Sequence
  Description of Artificial Sequence: Synthetic light chain variable region CDR L1
KSSQSLFYSSTNQHYLA

SEQ ID NO: 332 - DNA, 51 bp, Artificial Sequence
  Description of Artificial Sequence: Synthetic light chain variable region CDR L1
aagtccagccagagtcttttctacagctccaccaatcagcactacttggct

SEQ ID NO: 333 - protein, 7 aa, Artificial Sequence
  Description of Artificial Sequence: Synthetic light chain variable region CDR L2
WASIRES

SEQ ID NO: 334 - DNA, 21 bp, Artificial Sequence
  Description of Artificial Sequence: Synthetic light chain variable region CDR L2
tgggcatctatccgggaatcc

SEQ ID NO: 335 - protein, 9 aa, Artificial Sequence
  Description of Artificial Sequence: Synthetic light chain variable region CDR L3
QQYYSSPQT

SEQ ID NO: 336 - DNA, 27 bp, Artificial Sequence
  Description of Artificial Sequence: Synthetic light chain variable region CDR L3
cagcagtattatagtagtcctcaaact

SEQ ID NO: 337 - DNA, 363 bp, Artificial Sequence
  Description of Artificial Sequence: Synthetic heavy chain variable region
caggtccagcttgtgcagtctggaactgaggtgaagaagcctggggcctcagtgaaggtctcctgtaaggctgctggttacacctttagcaactacggtgtcagttgggtgcgacaggcccctggacaggggcttgagtggatgggatggatcagcgcttataatggtaacacaaaatttgcacagaaggtccagggcagactcaccatgaccacagacacatctaccagcacagcctacatggaattgaggaacctcagatctgacgacacggccgtgtattattgtgcgagagaatcaggggcaacagcggctgctatgtttgactactggggccagggaaccctggtcaccgtctcctca

SEQ ID NO: 338 - protein, 121 aa, Artificial Sequence; identical to SEQ ID NO: 34
  Description of Artificial Sequence: Synthetic heavy chain variable region

SEQ ID NO: 339 - protein, 9 aa, Artificial Sequence
  Description of Artificial Sequence: Synthetic heavy chain variable region CDR H1
YTFSNYGVS

SEQ ID NO: 340 - DNA, 27 bp, Artificial Sequence
  Description of Artificial Sequence: Synthetic heavy chain variable region CDR H1
tacacctttagcaactacggtgtcagt

SEQ ID NO: 341 - protein, 17 aa, Artificial Sequence
  Description of Artificial Sequence: Synthetic heavy chain variable region CDR H2
WISAYNGNTKFAQKVQG

SEQ ID NO: 342 - DNA, 51 bp, Artificial Sequence; identical to SEQ ID NO: 38
  Description of Artificial Sequence: Synthetic heavy chain variable region CDR H2

SEQ ID NO: 343 - protein, 14 aa, Artificial Sequence
  Description of Artificial Sequence: Synthetic heavy chain variable region CDR H3
ARESGATAAAMFDY

SEQ ID NO: 344 - DNA, 42 bp, Artificial Sequence; identical to SEQ ID NO: 40
  Description of Artificial Sequence: Synthetic heavy chain variable region CDR H3

SEQ ID NO: 345 - DNA, 336 bp, Artificial Sequence
  Description of Artificial Sequence: Synthetic light chain variable region
gaaattgtattgacgcagtctccactctccctgcccgtcacccttggacagccggcctccatctcctgcaggtctagtcaaagcctcgaatacagtgatggaaacatctacttgagttggtttcaacagaggccaggccaatctccaaggcgcctaatttataaggtttctcaccgggactctggggtcccagacagattcagcggcagtgggtcaggcactgatttcacactgaaaatcgccagggtggaggctgaggatgttgcagtttattactgcatgcaagctatacactggcctcgaacttttggccaggggaccaaggtggagatcaaa

SEQ ID NO: 346 - protein, 112 aa, Artificial Sequence
  Description of Artificial Sequence: Synthetic light chain variable region
EIVLTQSPLSLPVTLGQPASISCRSSQSLEYSDGNIYLSWFQQRPGQSPRRLIYKVSHRDSGVPDRFSGSGSGTDFTLKIARVEAEDVAVYYCMQAIHWPRTFGQGTKVEIK

SEQ ID NO: 347 - protein, 16 aa, Artificial Sequence
  Description of Artificial Sequence: Synthetic light chain variable region CDR L1
RSSQSLEYSDGNIYLS

SEQ ID NO: 348 - DNA, 48 bp, Artificial Sequence; identical to SEQ ID NO: 44
  Description of Artificial Sequence: Synthetic light chain variable region CDR L1

SEQ ID NO: 349 - protein, 7 aa, Artificial Sequence
  Description of Artificial Sequence: Synthetic light chain variable region CDR L2
KVSHRDS

SEQ ID NO: 350 - DNA, 21 bp, Artificial Sequence
  Description of Artificial Sequence: Synthetic light chain variable region CDR L2
aaggtttctcaccgggactct

SEQ ID NO: 351 - protein, 9 aa, Artificial Sequence
  Description of Artificial Sequence: Synthetic light chain variable region CDR L3
MQAIHWPRT

SEQ ID NO: 352 - DNA, 27 bp, Artificial Sequence
  Description of Artificial Sequence: Synthetic light chain variable region CDR L3
atgcaagctatacactggcctcgaact

SEQ ID NO: 353 - DNA, 366 bp, Artificial Sequence
  Description of Artificial Sequence: Synthetic heavy chain variable region
gaggtgcagctggtggagtctgggggaggcgtggtccagtctgggaggtccctgagactctcctgtgcagcgtctggattcaccttcagtgacaatggcatgcactgggtccgccaggctccaggcaaggggctggagtgggtggcaggtatattttatgatggaagtaataaacaatatgcagactccgtgaagggccgattcaccatctccagagacaattccaagagcacgctgtatctgcaaatgaacagcctgagagccgaggacacggctgtgtattactgtgcgagagccccttacgatatttggagtggttattgtcttgactactggggccagggaaccctggtcaccgtctcctca

SEQ ID NO: 354 - protein, 122 aa, Artificial Sequence
  Description of Artificial Sequence: Synthetic heavy chain variable region
EVQLVESGGGVVQSGRSLRLSCAASGFTFSDNGMHWVRQAPGKGLEWVAGIFYDGSNKQYADSVKGRFTISRDNSKSTLYLQMNSLRAEDTAVYYCARAPYDIWSGYCLDYWGQGTLVTVSS

SEQ ID NO: 355 - protein, 9 aa, Artificial Sequence
  Description of Artificial Sequence: Synthetic heavy chain variable region CDR H1
FTFSDNGMH

SEQ ID NO: 356 - DNA, 27 bp, Artificial Sequence
  Description of Artificial Sequence: Synthetic heavy chain variable region CDR H1
ttcaccttcagtgacaatggcatgcac

SEQ ID NO: 357 - protein, 17 aa, Artificial Sequence
  Description of Artificial Sequence: Synthetic heavy chain variable region CDR H2
GIFYDGSNKQYADSVKG

SEQ ID NO: 358 - DNA, 51 bp, Artificial Sequence; identical to SEQ ID NO: 310
  Description of Artificial Sequence: Synthetic heavy chain variable region CDR H2

SEQ ID NO: 359 - protein, 15 aa, Artificial Sequence
  Description of Artificial Sequence: Synthetic heavy chain variable region CDR H3
ARAPYDIWSGYCLDY

SEQ ID NO: 360 - DNA, 45 bp, Artificial Sequence; identical to SEQ ID NO: 312
  Description of Artificial Sequence: Synthetic heavy chain variable region CDR H3

SEQ ID NO: 361 - DNA, 321 bp, Artificial Sequence
  Description of Artificial Sequence: Synthetic light chain variable region
gacatccggttgacccagtctccagccaccctgtctatgtctccaggggaaagagccaccctctcctgcagggccagtcagagtgttaacaacaacttagcctggtaccagcagagacctggccaggctcccaggctcctcatctatggtgcatctaccagggccactggtatcccagccaggttcagtggcagtgggtctgagacagagttcactctcactatcagcagcctgcagtctgaagattttgcggtttatcactgtcagcagtatagtatctggcctcagacttttggccaggggaccaaagtggatatcaaa

SEQ ID NO: 362 - protein, 107 aa, Artificial Sequence
  Description of Artificial Sequence: Synthetic light chain variable region
DIRLTQSPATLSMSPGERATLSCRASQSVNNNLAWYQQRPGQAPRLLIYGASTRATGIPARFSGSGSETEFTLTISSLQSEDFAVYHCQQYSIWPQTFGQGTKVDIK

SEQ ID NO: 363 - protein, 11 aa, Artificial Sequence
  Description of Artificial Sequence: Synthetic light chain variable region CDR L1
RASQSVNNNLA

SEQ ID NO: 364 - DNA, 33 bp, Artificial Sequence; identical to SEQ ID NO: 316
  Description of Artificial Sequence: Synthetic light chain variable region CDR L1

SEQ ID NO: 365 - protein, 7 aa, Artificial Sequence
  Description of Artificial Sequence: Synthetic light chain variable region CDR L2
GASTRAT

SEQ ID NO: 366 - DNA, 21 bp, Artificial Sequence
  Description of Artificial Sequence: Synthetic light chain variable region CDR L2
ggtgcatctaccagggccact

SEQ ID NO: 367 - protein, 9 aa, Artificial Sequence
  Description of Artificial Sequence: Synthetic light chain variable region CDR L3
QQYSIWPQT

SEQ ID NO: 368 - DNA, 27 bp, Artificial Sequence
  Description of Artificial Sequence: Synthetic light chain variable region CDR L3
cagcagtatagtatctggcctcagact

SEQ ID NO: 369 - DNA, 366 bp, Artificial Sequence
  Description of Artificial Sequence: Synthetic heavy chain variable region
gaggtgcagctgttggagtctgggggagccttggtcgagcctggggggtccctgagactctcctgtgcagcctctggattctcctttaacacgtattccatgaactgggtccgccagggtccagggaagggactggagtgggtcgcaacgataagtacgagtactgctggctcatactacgcagactccgtgaggggccggttcaccatctctagagacaattccaagaacacgttatatctgcaaatgaacagtctgagagtcgaagacacggccgtatattactgtgcgagagatcaggaagtggaactgatcgatgatgcttttgatttctggggccgggggacaatggtcaccgtctcttca

SEQ ID NO: 370 - protein, 122 aa, Artificial Sequence
  Description of Artificial Sequence: Synthetic heavy chain variable region
EVQLLESGGALVEPGGSLRLSCAASGFSFNTYSMNWVRQGPGKGLEWVATISTSTAGSYYADSVRGRFTISRDNSKNTLYLQMNSLRVEDTAVYYCARDQEVELIDDAFDFWGRGTMVTVSS

SEQ ID NO: 371 - protein, 9 aa, Artificial Sequence
  Description of Artificial Sequence: Synthetic heavy chain variable region CDR H1
FSFNTYSMN

SEQ ID NO: 372 - DNA, 27 bp, Artificial Sequence
  Description of Artificial Sequence: Synthetic heavy chain variable region CDR H1
ttctcctttaacacgtattccatgaac

SEQ ID NO: 373 - protein, 17 aa, Artificial Sequence
  Description of Artificial Sequence: Synthetic heavy chain variable region CDR H2
TISTSTAGSYYADSVRG

SEQ ID NO: 374 - DNA, 51 bp, Artificial Sequence
  Description of Artificial Sequence: Synthetic heavy chain variable region CDR H2
acgataagtacgagtactgctggctcatactacgcagactccgtgaggggc

SEQ ID NO: 375 - protein, 15 aa, Artificial Sequence
  Description of Artificial Sequence: Synthetic heavy chain variable region CDR H3
ARDQEVELIDDAFDF

SEQ ID NO: 376 - DNA, 45 bp, Artificial Sequence
  Description of Artificial Sequence: Synthetic heavy chain variable region CDR H3
gcgagagatcaggaagtggaactgatcgatgatgcttttgatttc

SEQ ID NO: 377 - DNA, 318 bp, Artificial Sequence
  Description of Artificial Sequence: Synthetic light chain variable region
gatattgtgatgactcagacacattcctccctgtctgcatctgtgggagacagagtcaccatcacttgccgggccagtcagagtattagtatctgggtggcctggtatcagcagaaaccagggaaagcccctaacctcctgatctataaggcgtctagtttacaaagtggggtcccatcaaggttcagcggcagtggatctgggacagaattcactctcaccatcagcagcctgcagcctgatgactctgcaacttattactgccaacagtattacacctattacagttttggccaggggaccaagctggagatcaaa

SEQ ID NO: 378 - protein, 106 aa, Artificial Sequence
  Description of Artificial Sequence: Synthetic light chain variable region
DIVMTQTHSSLSASVGDRVTITCRASQSISIWVAWYQQKPGKAPNLLIYKASSLQSGVPSRFSGSGSGTEFTLTISSLQPDDSATYYCQQYYTYYSFGQGTKLEIK

SEQ ID NO: 379 - protein, 11 aa, Artificial Sequence
  Description of Artificial Sequence: Synthetic light chain variable region CDR L1
RASQSISIWVA

SEQ ID NO: 380 - DNA, 33 bp, Artificial Sequence
  Description of Artificial Sequence: Synthetic light chain variable region CDR L1
cgggccagtcagagtattagtatctgggtggcc

SEQ ID NO: 381 - protein, 7 aa, Artificial Sequence
  Description of Artificial Sequence: Synthetic light chain variable region CDR L2
KASSLQS

SEQ ID NO: 382 - DNA, 21 bp, Artificial Sequence
  Description of Artificial Sequence: Synthetic light chain variable region CDR L2
aaggcgtctagtttacaaagt

SEQ ID NO: 383 - protein, 8 aa, Artificial Sequence
  Description of Artificial Sequence: Synthetic light chain variable region CDR L3
QQYYTYYS

SEQ ID NO: 384 - DNA, 24 bp, Artificial Sequence
  Description of Artificial Sequence: Synthetic light chain variable region CDR L3
caacagtattacacctattacagt

SEQ ID NO: 385 - DNA, 363 bp, Artificial Sequence
  Description of Artificial Sequence: Synthetic heavy chain variable region
gaggtgcagctggtggagtctggggctgaggtgaagaggcctggggcctcagtgaaaatctcctgcaaggcttctgaatacgccttcaccgcccactatcttcactgggtgcgacaggcccctgatcaaggacttgagtggatgggatggatcagccctaaaagtggtggcaccaactatgcacagaagtttcacggcagggtcagcatgaccagtgacacgtccatcagtacagtctatatggaactgagcagcctgacatctgacgacacggccgtctattactgtgcgagaagcagtctggtgggagcaagccccaactttgacttctggggccagggaaccctggtcaccgtctcctca

SEQ ID NO: 386 - protein, 121 aa, Artificial Sequence
  Description of Artificial Sequence: Synthetic heavy chain variable region
EVQLVESGAEVKRPGASVKISCKASEYAFTAHYLHWVRQAPDQGLEWMGWISPKSGGTNYAQKFHGRVSMTSDTSISTVYMELSSLTSDDTAVYYCARSSLVGASPNFDFWGQGTLVTVSS

SEQ ID NO: 387 - protein, 9 aa, Artificial Sequence
  Description of Artificial Sequence: Synthetic heavy chain variable region CDR H1
YAFTAHYLH

SEQ ID NO: 388 - DNA, 27 bp, Artificial Sequence
  Description of Artificial Sequence: Synthetic heavy chain variable region CDR H1
tacgccttcaccgcccactatcttcac

SEQ ID NO: 389 - protein, 17 aa, Artificial Sequence
  Description of Artificial Sequence: Synthetic heavy chain variable region CDR H2
WISPKSGGTNYAQKFHG

SEQ ID NO: 390 - DNA, 51 bp, Artificial Sequence
  Description of Artificial Sequence: Synthetic heavy chain variable region CDR H2
tggatcagccctaaaagtggtggcaccaactatgcacagaagtttcacggc

SEQ ID NO: 391 - protein, 14 aa, Artificial Sequence
  Description of Artificial Sequence: Synthetic heavy chain variable region CDR H3
ARSSLVGASPNFDF

SEQ ID NO: 392 - DNA, 42 bp, Artificial Sequence
  Description of Artificial Sequence: Synthetic heavy chain variable region CDR H3
gcgagaagcagtctggtgggagcaagccccaactttgacttc

SEQ ID NO: 393 - DNA, 333 bp, Artificial Sequence
  Description of Artificial Sequence: Synthetic light chain variable region
cagtctgtgctgacgcagccgccctcagtgtctgcggccccaggacagagggtcaccatctcctgctctggaagcagctccaacattgggaataattatgtatcctggtaccagcaactcccaggaactacccccaaagtcctcatttacgacaataatcagcgaccctcagggattcctgaccgtttctctggctccaagtctggcacgtcagccaccctggccatcagcggactccagactggcgacgaggccgtctattattgcggaacatgggatgccagcctgagtgctgctatggttttcggcggggggaccaagctcaccgtccta

SEQ ID NO: 394 - protein, 111 aa, Artificial Sequence
  Description of Artificial Sequence: Synthetic light chain variable region
QSVLTQPPSVSAAPGQRVTISCSGSSSNIGNNYVSWYQQLPGTTPKVLIYDNNQRPSGIPDRFSGSKSGTSATLAISGLQTGDEAVYYCGTWDASLSAAMVFGGGTKLTVL

SEQ ID NO: 395 - protein, 13 aa, Artificial Sequence
  Description of Artificial Sequence: Synthetic light chain variable region CDR L1
SGSSSNIGNNYVS

SEQ ID NO: 396 - DNA, 39 bp, Artificial Sequence
  Description of Artificial Sequence: Synthetic light chain variable region CDR L1
tctggaagcagctccaacattgggaataattatgtatcc

SEQ ID NO: 397 - protein, 7 aa, Artificial Sequence
  Description of Artificial Sequence: Synthetic light chain variable region CDR L2
DNNQRPS

SEQ ID NO: 398 - DNA, 21 bp, Artificial Sequence
  Description of Artificial Sequence: Synthetic light chain variable region CDR L2
gacaataatcagcgaccctca

SEQ ID NO: 399 - protein, 12 aa, Artificial Sequence
  Description of Artificial Sequence: Synthetic light chain variable region CDR L3
GTWDASLSAAMV

SEQ ID NO: 400 - DNA, 36 bp, Artificial Sequence
  Description of Artificial Sequence: Synthetic light chain variable region CDR L3
ggaacatgggatgccagcctgagtgctgctatggtt

SEQ ID NO: 401 - DNA, 363 bp, Artificial Sequence
  Description of Artificial Sequence: Synthetic heavy chain variable region
caggtgcagctgcaggagtcgggcccaggactggtgaagccttcggagaccctgtccctcacctgcactgtctctggtggctccatcagcggatattactggagctggatccggcagcccccagggaggggactggagtggattgggtttatttattatagtgggagtaccagctacgactcctccctcaagagtcgagtcaccatatcagtagacacgtccaagaaccagttctccctaaacctgagctctgtgaccgctgcggacacggccgtatattactgtgcgagaagtacatgggactacggtgaccactttccgtttgactactggggccagggaaccctggtcaccgtctcctca

SEQ ID NO: 402 - protein, 121 aa, Artificial Sequence
  Description of Artificial Sequence: Synthetic heavy chain variable region
QVQLQESGPGLVKPSETLSLTCTVSGGSISGYYWSWIRQPPGRGLEWIGFIYYSGSTSYDSSLKSRVTISVDTSKNQFSLNLSSVTAADTAVYYCARSTWDYGDHFPFDYWGQGTLVTVSS

SEQ ID NO: 403 - protein, 9 aa, Artificial Sequence
  Description of Artificial Sequence: Synthetic heavy chain variable region CDR H1
GSISGYYWS

SEQ ID NO: 404 - DNA, 27 bp, Artificial Sequence
  Description of Artificial Sequence: Synthetic heavy chain variable region CDR H1
ggctccatcagcggatattactggagc

SEQ ID NO: 405 - protein, 16 aa, Artificial Sequence
  Description of Artificial Sequence: Synthetic heavy chain variable region CDR H2
FIYYSGSTSYDSSLKS

SEQ ID NO: 406 - DNA, 48 bp, Artificial Sequence
  Description of Artificial Sequence: Synthetic heavy chain variable region CDR H2
tttatttattatagtgggagtaccagctacgactcctccctcaagagt

SEQ ID NO: 407 - protein, 15 aa, Artificial Sequence
  Description of Artificial Sequence: Synthetic heavy chain variable region CDR H3
ARSTWDYGDHFPFDY

SEQ ID NO: 408 - DNA, 45 bp, Artificial Sequence
  Description of Artificial Sequence: Synthetic heavy chain variable region CDR H3
gcgagaagtacatgggactacggtgaccactttccgtttgactac

SEQ ID NO: 409 - DNA, 327 bp, Artificial Sequence
  Description of Artificial Sequence: Synthetic light chain variable region
tcctatgagctgactcagccaccctcagtgtcagtggccccaggaaagacggccaggattacctgtgggggaaacaacattggaattaaagatgtgcactggtaccaactgaggccaggccaggcccctgtgttggtcatctcttatgatagcgaccggccctcagggatccctgagcgattctctggctccaactctgggaacacggccaccctgaccatcagcagggtcgaagccggggatgaggccgactatttctgtcaggtgtgggatagtagtcctgatcatccttatgtcttcggaactgggaccaagctcaccgtccta

SEQ ID NO: 410 - protein, 109 aa, Artificial Sequence
  Description of Artificial Sequence: Synthetic light chain variable region
SYELTQPPSVSVAPGKTARITCGGNNIGIKDVHWYQLRPGQAPVLVISYDSDRPSGIPERFSGSNSGNTATLTISRVEAGDEADYFCQVWDSSPDHPYVFGTGTKLTVL

SEQ ID NO: 411 - protein, 11 aa, Artificial Sequence
  Description of Artificial Sequence: Synthetic light chain variable region CDR L1
GGNNIGIKDVH

SEQ ID NO: 412 - DNA, 33 bp, Artificial Sequence
  Description of Artificial Sequence: Synthetic light chain variable region CDR L1
gggggaaacaacattggaattaaagatgtgcac

SEQ ID NO: 413 - protein, 7 aa, Artificial Sequence
  Description of Artificial Sequence: Synthetic light chain variable region CDR L2
YDSDRPS

SEQ ID NO: 414 - DNA, 21 bp, Artificial Sequence
  Description of Artificial Sequence: Synthetic light chain variable region CDR L2
tatgatagcgaccggccctca

SEQ ID NO: 415 - protein, 12 aa, Artificial Sequence
  Description of Artificial Sequence: Synthetic light chain variable region CDR L3
QVWDSSPDHPYV

SEQ ID NO: 416 - DNA, 36 bp, Artificial Sequence
  Description of Artificial Sequence: Synthetic light chain variable region CDR L3
caggtgtgggatagtagtcctgatcatccttatgtc

SEQ ID NO: 417 - DNA, 363 bp, Artificial Sequence
  Description of Artificial Sequence: Synthetic heavy chain variable region
gaggtgcagctggtggagtctggaggtgaggtgaagaagcctggggcctcagtgaaggtctcctgcagggcctctggttacacctttagaaactatggcctcacctgggtgcggcaggcccccggacaagggcttgagtggatgggatggatcagcgcttacaatggaaacacaaactatgcacagaagttccagggcagagtcacactgaccacggacacatccacgagcacagcctacatggaactgaggagcctaagatctgacgacacggccgtgtatttctgtgcgagagacgtccccggccacggcgctgccttcatggacgtctggggcacagggaccacggtcaccgtctcctca

SEQ ID NO: 418 - protein, 121 aa, Artificial Sequence
  Description of Artificial Sequence: Synthetic heavy chain variable region
EVQLVESGGEVKKPGASVKVSCRASGYTFRNYGLTWVRQAPGQGLEWMGWISAYNGNTNYAQKFQGRVTLTTDTSTSTAYMELRSLRSDDTAVYFCARDVPGHGAAFMDVWGTGTTVTVSS

SEQ ID NO: 419 - protein, 9 aa, Artificial Sequence
  Description of Artificial Sequence: Synthetic heavy chain variable region CDR H1
YTFRNYGLT

SEQ ID NO: 420 - DNA, 27 bp, Artificial Sequence
  Description of Artificial Sequence: Synthetic heavy chain variable region CDR H1
tacacctttagaaactatggcctcacc

SEQ ID NO: 421 - protein, 17 aa, Artificial Sequence
  Description of Artificial Sequence: Synthetic heavy chain variable region CDR H2
WISAYNGNTNYAQKFQG

SEQ ID NO: 422 - DNA, 51 bp, Artificial Sequence; identical to SEQ ID NO: 70
  Description of Artificial Sequence: Synthetic heavy chain variable region CDR H2

SEQ ID NO: 423 - protein, 14 aa, Artificial Sequence
  Description of Artificial Sequence: Synthetic heavy chain variable region CDR H3
ARDVPGHGAAFMDV

SEQ ID NO: 424 - DNA, 42 bp, Artificial Sequence; identical to SEQ ID NO: 72
  Description of Artificial Sequence: Synthetic heavy chain variable region CDR H3

SEQ ID NO: 425 - DNA, 336 bp, Artificial Sequence
  Description of Artificial Sequence: Synthetic light chain variable region
gaaacgacactcacgcagtctccactctccctgcccgtcacccttgggcagccggcctccatctcctgcaggtctagtcaaagcctcgaagccagtgatacaaatatctacttgagttggtttcagcagaggccaggccaatctccaaggcgcctaatttataagatttctaaccgagactctggggtcccagacagattcagcggcagtgggtcaggcactcatttcacactgagaatcagcagggtggaggctgacgatgttgcggtttattactgcatgcagggtacacactggcctccggcgttcggccaggggaccaagctggagatcaaa

SEQ ID NO: 426 - protein, 112 aa, Artificial Sequence
  Description of Artificial Sequence: Synthetic light chain variable region
ETTLTQSPLSLPVTLGQPASISCRSSQSLEASDTNIYLSWFQQRPGQSPRRLIYKISNRDSGVPDRFSGSGSGTHFTLRISRVEADDVAVYYCMQGTHWPPAFGQGTKLEIK

SEQ ID NO: 427 - protein, 16 aa, Artificial Sequence
  Description of Artificial Sequence: Synthetic light chain variable region CDR L1
RSSQSLEASDTNIYLS

SEQ ID NO: 428 - DNA, 48 bp, Artificial Sequence; identical to SEQ ID NO: 76
  Description of Artificial Sequence: Synthetic light chain variable region CDR L1

SEQ ID NO: 429 - protein, 7 aa, Artificial Sequence
  Description of Artificial Sequence: Synthetic light chain variable region CDR L2
KISNRDS

SEQ ID NO: 430 - DNA, 21 bp, Artificial Sequence
  Description of Artificial Sequence: Synthetic light chain variable region CDR L2
aagatttctaaccgagactct

SEQ ID NO: 431 - protein, 9 aa, Artificial Sequence
  Description of Artificial Sequence: Synthetic light chain variable region CDR L3
MQGTHWPPA

SEQ ID NO: 432 - DNA, 27 bp, Artificial Sequence
  Description of Artificial Sequence: Synthetic light chain variable region CDR L3
atgcagggtacacactggcctccggcg

SEQ ID NO: 433 - DNA, 363 bp, Artificial Sequence
  Description of Artificial Sequence: Synthetic heavy chain variable region
gaggtgcagctggtggagtctggatctgaggtgaagaagcctggggccgcagtgaaggtatcctgcaaggcttctggttacatctttgccaactttggtgtcagctgggtgcgacaggcccctggacaagggcttgagtggatgggatggatcagcgcttacaatggtaacacaaactatgcacagaagttccagggcagagtcatcatgaccacagacacatccacgagcacagcctacatggagctgaggagcctgagatctgacgacacggccgtgtattattgtgcgagagacccccccgcctacgccgctacattgatggacgtctggggcaaagggaccacggtcaccgtctcctca

SEQ ID NO: 434 - protein, 121 aa, Artificial Sequence
  Description of Artificial Sequence: Synthetic heavy chain variable region
EVQLVESGSEVKKPGAAVKVSCKASGYIFANFGVSWVRQAPGQGLEWMGWISAYNGNTNYAQKFQGRVIMTTDTSTSTAYMELRSLRSDDTAVYYCARDPPAYAATLMDVWGKGTTVTVSS

SEQ ID NO: 435 - protein, 9 aa, Artificial Sequence
  Description of Artificial Sequence: Synthetic heavy chain variable region CDR H1
YIFANFGVS

SEQ ID NO: 436 - DNA, 27 bp, Artificial Sequence
  Description of Artificial Sequence: Synthetic heavy chain variable region CDR H1
tacatctttgccaactttggtgtcagc

SEQ ID NO: 437 - protein, 17 aa, Artificial Sequence
  Description of Artificial Sequence: Synthetic heavy chain variable region CDR H2
WISAYNGNTNYAQKFQG

SEQ ID NO: 438 - DNA, 51 bp, Artificial Sequence; identical to SEQ ID NO: 86
  Description of Artificial Sequence: Synthetic heavy chain variable region CDR H2

SEQ ID NO: 439 - protein, 14 aa, Artificial Sequence
  Description of Artificial Sequence: Synthetic heavy chain variable region CDR H3
ARDPPAYAATLMDV

SEQ ID NO: 440 - DNA, 42 bp, Artificial Sequence; identical to SEQ ID NO: 88
  Description of Artificial Sequence: Synthetic heavy chain variable region CDR H3

SEQ ID NO: 441 - DNA, 336 bp, Artificial Sequence
  Description of Artificial Sequence: Synthetic light chain variable region
gatattgtgatgactcagtctccactctccctgcccgtcacccttggacagtcggcctccatctcctgcaggtctagtcaaagcctcgaacacagtgatacaaacacctacttgacttggtatcagcagaggccaggccaatctccaaggcggctactttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccaagggaccaagctggagatcaaa

SEQ ID NO: 442 - protein, 112 aa, Artificial Sequence
  Description of Artificial Sequence: Synthetic light chain variable region
DIVMTQSPLSLPVTLGQSASISCRSSQSLEHSDTNTYLTWYQQRPGQSPRRLLYKVSNRDSGVPDRFSGSGSGTDFTLKISRVEAEDVGVYYCMQGTHWPPTFGQGTKLEIK

SEQ ID NO: 443 - protein, 16 aa, Artificial Sequence
  Description of Artificial Sequence: Synthetic light chain variable region CDR L1
RSSQSLEHSDTNTYLT

SEQ ID NO: 444 - DNA, 48 bp, Artificial Sequence; identical to SEQ ID NO: 92
  Description of Artificial Sequence: Synthetic light chain variable region CDR L1

SEQ ID NO: 445 - protein, 7 aa, Artificial Sequence
  Description of Artificial Sequence: Synthetic light chain variable region CDR L2
KVSNRDS

SEQ ID NO: 446 - DNA, 21 bp, Artificial Sequence
  Description of Artificial Sequence: Synthetic light chain variable region CDR L2
aaggtttctaaccgggactct

SEQ ID NO: 447 - protein, 9 aa, Artificial Sequence
  Description of Artificial Sequence: Synthetic light chain variable region CDR L3
MQGTHWPPT

SEQ ID NO: 448 - DNA, 27 bp, Artificial Sequence
  Description of Artificial Sequence: Synthetic light chain variable region CDR L3
atgcaaggtacacactggcctccgacg

SEQ ID NO: 449 - DNA, 399 bp, Artificial Sequence
  Description of Artificial Sequence: Synthetic heavy chain variable region
gaggtgcagctggtggagtctggcccaacactggtgaagccttcggagaccctgtccctcacctgcgttgtctctggtggctccgtctacaggagtagtaactactgggcctggatccgccagcccccagggaaggggctggagtggatcgggagtgtctatcatagtgggaacccctactccaacccgtcccttcagagtcgagtctccgtctccattgacacgtccaagaaccagttctccctgaagctgtactctgtgaccgccgcagactcggctatttattattgtgcgtgtaaaagagcggacgctgacgacgtagattacgtggcgggcctcaccggtttcccctggtacttcgatgtctggggccgtggcaccctggtcaccgtctcctca

SEQ ID NO: 450 - protein, 133 aa, Artificial Sequence
  Description of Artificial Sequence: Synthetic heavy chain variable region
EVQLVESGPTLVKPSETLSLTCVVSGGSVYRSSNYWAWIRQPPGKGLEWIGSVYHSGNPYSNPSLQSRVSVSIDTSKNQFSLKLYSVTAADSAIYYCACKRADADDVDYVAGLTGFPWYFDVWGRGTLVTVSS

SEQ ID NO: 451 - protein, 11 aa, Artificial Sequence
  Description of Artificial Sequence: Synthetic heavy chain variable region CDR H1
GSVYRSSNYWA

SEQ ID NO: 452 - DNA, 33 bp, Artificial Sequence
  Description of Artificial Sequence: Synthetic heavy chain variable region CDR H1
ggctccgtctacaggagtagtaactactgggcc

SEQ ID NO: 453 - protein, 16 aa, Artificial Sequence
  Description of Artificial Sequence: Synthetic heavy chain variable region CDR H2
SVYHSGNPYSNPSLQS

SEQ ID NO: 454 - DNA, 48 bp, Artificial Sequence
  Description of Artificial Sequence: Synthetic heavy chain variable region CDR H2
agtgtctatcatagtgggaacccctactccaacccgtcccttcagagt

SEQ ID NO: 455 - protein, 25 aa, Artificial Sequence
  Description of Artificial Sequence: Synthetic heavy chain variable region CDR H3
ACKRADADDVDYVAGLTGFPWYFDV

SEQ ID NO: 456 - DNA, 75 bp, Artificial Sequence
  Description of Artificial Sequence: Synthetic heavy chain variable region CDR H3
gcgtgtaaaagagcggacgctgacgacgtagattacgtggcgggcctcaccggtttcccctggtacttcgatgtc

SEQ ID NO: 457 - DNA, 324 bp, Artificial Sequence
  Description of Artificial Sequence: Synthetic light chain variable region
gaaattgtgttgacgcagtctccgtccaccctgtctgcatctgtgggagacagagtcaccatcacttgccgggccagtcagagtattagtagttggttggcctggtatcagcagaaaccagggaaaacccctaagttgctcatctataaggcgtctactttagaaagtggggtcccatcaaggttcagcggcagcggatctgggacagaattcactctcaccatcagcagcctgcagcctgatgatttcgcaacctactactgccaacagtatcatgtttatttcccgctcactttcggcggagggaccaaggtggaaatcaaa

SEQ ID NO: 458 - protein, 108 aa, Artificial Sequence
  Description of Artificial Sequence: Synthetic light chain variable region
EIVLTQSPSTLSASVGDRVTITCRASQSISSWLAWYQQKPGKTPKLLIYKASTLESGVPSRFSGSGSGTEFTLTISSLQPDDFATYYCQQYHVYFPLTFGGGTKVEIK

SEQ ID NO: 459 - protein, 11 aa, Artificial Sequence
  Description of Artificial Sequence: Synthetic light chain variable region CDR L1
RASQSISSWLA

SEQ ID NO: 460 - DNA, 33 bp, Artificial Sequence
  Description of Artificial Sequence: Synthetic light chain variable region CDR L1
cgggccagtcagagtattagtagttggttggcc

SEQ ID NO: 461 - protein, 7 aa, Artificial Sequence
  Description of Artificial Sequence: Synthetic light chain variable region CDR L2
KASTLES

SEQ ID NO: 462 - DNA, 21 bp, Artificial Sequence
  Description of Artificial Sequence: Synthetic light chain variable region CDR L2
aaggcgtctactttagaaagt

SEQ ID NO: 463 - protein, 10 aa, Artificial Sequence
  Description of Artificial Sequence: Synthetic light chain variable region CDR L3
QQYHVYFPLT

SEQ ID NO: 464 - DNA, 30 bp, Artificial Sequence
  Description of Artificial Sequence: Synthetic light chain variable region CDR L3
caacagtatcatgtttatttcccgctcact

SEQ ID NO: 465 - DNA, 360 bp, Artificial Sequence
  Description of Artificial Sequence: Synthetic heavy chain variable region
gaggtgcagctggtggagtctgggggaggcgtggtccagcctgggaggtccctgagactctcctgtgtagcgtctggattcagcttcagtatgcatggcatgcactgggtccgccaggctccaggcaaggggctggagtgggtgacagctatatggtatgatggaagtaataaatattatgcagactccgtgaagggccgattcacgatctccagagacaattctaggaacacgctgtatctgcaaatgaacagcctgagagccgaggacacggctgtgtattactgtgcgagagatcatgcctcaactccatactacatggacgtctggggcaaagggaccacggtcaccgtctcttca

SEQ ID NO: 466 - protein, 120 aa, Artificial Sequence
  Description of Artificial Sequence: Synthetic heavy chain variable region
EVQLVESGGGVVQPGRSLRLSCVASGFSFSMHGMHWVRQAPGKGLEWVTAIWYDGSNKYYADSVKGRFTISRDNSRNTLYLQMNSLRAEDTAVYYCARDHASTPYYMDVWGKGTTVTVSS

SEQ ID NO: 467 - protein, 9 aa, Artificial Sequence
  Description of Artificial Sequence: Synthetic heavy chain variable region CDR H1
FSFSMHGMH

SEQ ID NO: 468 - DNA, 27 bp, Artificial Sequence
  Description of Artificial Sequence: Synthetic heavy chain variable region CDR H1
ttcagcttcagtatgcatggcatgcac

SEQ ID NO: 469 - protein, 17 aa, Artificial Sequence
  Description of Artificial Sequence: Synthetic heavy chain variable region CDR H2
AIWYDGSNKYYADSVKG

SEQ ID NO: 470 - DNA, 51 bp, Artificial Sequence; identical to SEQ ID NO: 182
  Description of Artificial Sequence: Synthetic heavy chain variable region CDR H2

SEQ ID NO: 471 - protein, 13 aa, Artificial Sequence
  Description of Artificial Sequence: Synthetic heavy chain variable region CDR H3
ARDHASTPYYMDV

SEQ ID NO: 472 - DNA, 39 bp, Artificial Sequence; identical to SEQ ID NO: 184
  Description of Artificial Sequence: Synthetic heavy chain variable region CDR H3

SEQ ID NO: 473 - DNA, 324 bp, Artificial Sequence
  Description of Artificial Sequence: Synthetic light chain variable region
gaaacgacactcacgcagtctccaggcaccctgtctttgtctccaggggaaagcgccaccctctcctgcaggaccagtcagaggattagcagcacctacttagcctggtaccggcagaaacctggccaggctcccaggctcctcatgtatggtgcatccagcagggccactggcatcccggacaggttcagtggcagtgggtctgggacagacttcactctcaccatcagcagtctggagcctgaagattttgcactatattactgtcagcagtatggtagctttccgtggacgttcggccaagggaccaaggtggaaatcaaa

SEQ ID NO: 474 - protein, 108 aa, Artificial Sequence
  Description of Artificial Sequence: Synthetic light chain variable region
ETTLTQSPGTLSLSPGESATLSCRTSQRISSTYLAWYRQKPGQAPRLLMYGASSRATGIPDRFSGSGSGTDFTLTISSLEPEDFALYYCQQYGSFPWTFGQGTKVEIK

SEQ ID NO: 475 - protein, 12 aa, Artificial Sequence
  Description of Artificial Sequence: Synthetic light chain variable region CDR L1
RTSQRISSTYLA

SEQ ID NO: 476 - DNA, 36 bp, Artificial Sequence; identical to SEQ ID NO: 188
  Description of Artificial Sequence: Synthetic light chain variable region CDR L1

SEQ ID NO: 477 - protein, 7 aa, Artificial Sequence
  Description of Artificial Sequence: Synthetic light chain variable region CDR L2
GASSRAT

SEQ ID NO: 478 - DNA, 21 bp, Artificial Sequence
  Description of Artificial Sequence: Synthetic light chain variable region CDR L2
ggtgcatccagcagggccact

SEQ ID NO: 479 - protein, 9 aa, Artificial Sequence
  Description of Artificial Sequence: Synthetic light chain variable region CDR L3
QQYGSFPWT

SEQ ID NO: 480 - DNA, 27 bp, Artificial Sequence
  Description of Artificial Sequence: Synthetic light chain variable region CDR L3
cagcagtatggtagctttccgtggacg

SEQ ID NO: 481 - DNA, 360 bp, Artificial Sequence
  Description of Artificial Sequence: Synthetic heavy chain variable region
caggtccagctggtgcagtctgggcctgaggtgaagaagcctgggtcctcggtgaaggtctcctgcaaggcttctggaggcaccttcagcagttatgctatcacgtgggtgcgacaggcccctggacaagggcttgagtggatgggggggatcatcccttcctttgatagagtggactattcacggaacttcaaggggagagtcacctttaccgcggacaaatccgcgaacacggcctacatggaactgaccaatgtgagatccgacgacacggccgtgtattactgtgcgagaggctgttgtggggctgtggctggattccagcactggggccagggcaccggggtcaccgtctcctca

SEQ ID NO: 482 - protein, 120 aa, Artificial Sequence
  Description of Artificial Sequence: Synthetic heavy chain variable region
QVQLVQSGPEVKKPGSSVKVSCKASGGTFSSYAITWVRQAPGQGLEWMGGIIPSFDRVDYSRNFKGRVTFTADKSANTAYMELTNVRSDDTAVYYCARGCCGAVAGFQHWGQGTGVTVSS

SEQ ID NO: 483 - protein, 9 aa, Artificial Sequence
  Description of Artificial Sequence: Synthetic heavy chain variable region CDR H1
GTFSSYAIT

SEQ ID NO: 484 - DNA, 27 bp, Artificial Sequence
  Description of Artificial Sequence: Synthetic heavy chain variable region CDR H1
ggcaccttcagcagttatgctatcacg

SEQ ID NO: 485 - protein, 17 aa, Artificial Sequence
  Description of Artificial Sequence: Synthetic heavy chain variable region CDR H2
GIIPSFDRVDYSRNFKG

SEQ ID NO: 486 - DNA, 51 bp, Artificial Sequence
  Description of Artificial Sequence: Synthetic heavy chain variable region CDR H2
gggatcatcccttcctttgatagagtggactattcacggaacttcaagggg

SEQ ID NO: 487 - protein, 13 aa, Artificial Sequence
  Description of Artificial Sequence: Synthetic heavy chain variable region CDR H3
ARGCCGAVAGFQH

SEQ ID NO: 488 - DNA, 39 bp, Artificial Sequence
  Description of Artificial Sequence: Synthetic heavy chain variable region CDR H3
gcgagaggctgttgtggggctgtggctggattccagcac

SEQ ID NO: 489 - DNA, 318 bp, Artificial Sequence
  Description of Artificial Sequence: Synthetic light chain variable region
gatattgtgctgacgcagactccagccaccctgtctttatctccaggggaaacagccaccctctcctgcagggccagtcagagtgttaccacctacttagcctggtaccagcagaaacctggccaggctcccaggctcctcatctatgatgcatccaacagggccactggcgtcccaaccaggttcagtggcagtgggtctgggacagacttcactctcaccatcagcagcctggagcctgaagattatgcgatttattactgtcagcaacgtactaccggggtcactttcggcggggggaccaaggtggaaatcaaa

SEQ ID NO: 490 - protein, 106 aa, Artificial Sequence
  Description of Artificial Sequence: Synthetic light chain variable region
DIVLTQTPATLSLSPGETATLSCRASQSVTTYLAWYQQKPGQAPRLLIYDASNRATGVPTRFSGSGSGTDFTLTISSLEPEDYAIYYCQQRTTGVTFGGGTKVEIK

SEQ ID NO: 491 - protein, 11 aa, Artificial Sequence
  Description of Artificial Sequence: Synthetic light chain variable region CDR L1
RASQSVTTYLA

SEQ ID NO: 492 - DNA, 33 bp, Artificial Sequence
  Description of Artificial Sequence: Synthetic light chain variable region CDR L1
agggccagtcagagtgttaccacctacttagcc

SEQ ID NO: 493 - protein, 7 aa, Artificial Sequence
  Description of Artificial Sequence: Synthetic light chain variable region CDR L2
DASNRAT

SEQ ID NO: 494 - DNA, 21 bp, Artificial Sequence
  Description of Artificial Sequence: Synthetic light chain variable region CDR L2
gatgcatccaacagggccact

SEQ ID NO: 495 - protein, 8 aa, Artificial Sequence
  Description of Artificial Sequence: Synthetic light chain variable region CDR L3
QQRTTGVT

SEQ ID NO: 496 - DNA, 24 bp, Artificial Sequence
  Description of Artificial Sequence: Synthetic light chain variable region CDR L3
cagcaacgtactaccggggtcact

SEQ ID NO: 497 - DNA, 369 bp, Artificial Sequence
  Description of Artificial Sequence: Synthetic heavy chain variable region
caggtgcagctggtggagtctgggggaggcctggtcaagcctggggggtccctgagactctcttgtgcagcctctggattcaccttcagtagttttggcatgcattgggtccgccaggctccagggcagggactggagtgggtcgcatccattactggtggcagcagttacataaactacgcagactcagtgaagggccgattcaccatctccagagacaacgccaagaagtcactgtctctgcaaatgaagaacctgagagccgaggacacggctgagtattactgtgtgcgaggagtcctaccaggtggtactggggggggctggttcgactcctggggccagggaaccctggtcaccgtctcctca

SEQ ID NO: 498 - protein, 123 aa, Artificial Sequence
  Description of Artificial Sequence: Synthetic heavy chain variable region
QVQLVESGGGLVKPGGSLRLSCAASGFTFSSFGMHWVRQAPGQGLEWVASITGGSSYINYADSVKGRFTISRDNAKKSLSLQMKNLRAEDTAEYYCVRGVLPGGTGGGWFDSWGQGTLVTVSS

SEQ ID NO: 499 - protein, 9 aa, Artificial Sequence
  Description of Artificial Sequence: Synthetic heavy chain variable region CDR H1
FTFSSFGMH

SEQ ID NO: 500 - DNA, 27 bp, Artificial Sequence
  Description of Artificial Sequence: Synthetic heavy chain variable region CDR H1
ttcaccttcagtagttttggcatgcat

SEQ ID NO: 501 - protein, 17 aa, Artificial Sequence
  Description of Artificial Sequence: Synthetic heavy chain variable region CDR H2
SITGGSSYINYADSVKG

SEQ ID NO: 502 - DNA, 51 bp, Artificial Sequence
  Description of Artificial Sequence: Synthetic heavy chain variable region CDR H2
tccattactggtggcagcagttacataaactacgcagactcagtgaagggc

SEQ ID NO: 503 - protein, 16 aa, Artificial Sequence
  Description of Artificial Sequence: Synthetic heavy chain variable region CDR H3
VRGVLPGGTGGGWFDS

SEQ ID NO: 504 - DNA, 48 bp, Artificial Sequence
  Description of Artificial Sequence: Synthetic heavy chain variable region CDR H3
gtgcgaggagtcctaccaggtggtactggggggggctggttcgactcc

SEQ ID NO: 505 - DNA, 330 bp, Artificial Sequence
  Description of Artificial Sequence: Synthetic light chain variable region
cagtctgtcctgactcagccgccctcaatgtctggggccccagggcagagggtcaccatctcctgcactgggaccagctccaacatcggggcgggttatgatgtacagtggtatcagcagtttccaggaacagcccccaaactcctcatctctggtaacaacaatcggccctcaggggtccctgaccgattctctggctccaagtctggcgcctcagcctccctggccatcactgggctccaggctgaggatgaggctgattattactgccagtcctatgactacagcctgaattgggtgttcggcggagggaccaagctcaccgtccta

SEQ ID NO: 506 - protein, 110 aa, Artificial Sequence
  Description of Artificial Sequence: Synthetic light chain variable region
QSVLTQPPSMSGAPGQRVTISCTGTSSNIGAGYDVQWYQQFPGTAPKLLISGNNNRPSGVPDRFSGSKSGASASLAITGLQAEDEADYYCQSYDYSLNWVFGGGTKLTVL

SEQ ID NO: 507 - protein, 14 aa, Artificial Sequence
  Description of Artificial Sequence: Synthetic light chain variable region CDR L1
TGTSSNIGAGYDVQ

SEQ ID NO: 508 - DNA, 42 bp, Artificial Sequence
  Description of Artificial Sequence: Synthetic light chain variable region CDR L1
actgggaccagctccaacatcggggcgggttatgatgtacag

SEQ ID NO: 509 - protein, 7 aa, Artificial Sequence
  Description of Artificial Sequence: Synthetic light chain variable region CDR L2
GNNNRPS

SEQ ID NO: 510 - DNA, 21 bp, Artificial Sequence
  Description of Artificial Sequence: Synthetic light chain variable region CDR L2
ggtaacaacaatcggccctca

SEQ ID NO: 511 - protein, 10 aa, Artificial Sequence
  Description of Artificial Sequence: Synthetic light chain variable region CDR L3
QSYDYSLNWV

SEQ ID NO: 512 - DNA, 30 bp, Artificial Sequence
  Description of Artificial Sequence: Synthetic light chain variable region CDR L3
cagtcctatgactacagcctgaattgggtg

SEQ ID NO: 513 - DNA, 381 bp, Artificial Sequence
  Description of Artificial Sequence: Synthetic heavy chain variable region
caggtgcagctgcaggagtcgggcccaggactggtgaagccttcacagaccctgtcgctcacctgcactgtctctggtcgcttcctcaatagtggtgattactactggagttggatccgccagtccccagggaagggcctggagtggcttggttacatccatcacagtgggaacacctactacaacccgtccctcaagagtcgacttaccatatcactagacatgtccaagaaccagttctccctgaagttgagctctgtgacagccgcagacacggccgtctattactgtgccagagatttgggaaagccgctttgggacggccactattactacggagtggacgtctggggccaagggaccacggtcaccgtctcctca

SEQ ID NO: 514 - protein, 127 aa, Artificial Sequence
  Description of Artificial Sequence: Synthetic heavy chain variable region
QVQLQESGPGLVKPSQTLSLTCTVSGRFLNSGDYYWSWIRQSPGKGLEWLGYIHHSGNTYYNPSLKSRLTISLDMSKNQFSLKLSSVTAADTAVYYCARDLGKPLWDGHYYYGVDVWGQGTTVTVSS

SEQ ID NO: 515 - protein, 11 aa, Artificial Sequence
  Description of Artificial Sequence: Synthetic heavy chain variable region CDR H1
RFLNSGDYYWS

SEQ ID NO: 516 - DNA, 33 bp, Artificial Sequence
  Description of Artificial Sequence: Synthetic heavy chain variable region CDR H1
cgcttcctcaatagtggtgattactactggagt

SEQ ID NO: 517 - protein, 16 aa, Artificial Sequence
  Description of Artificial Sequence: Synthetic heavy chain variable region CDR H2
YIHHSGNTYYNPSLKS

SEQ ID NO: 518 - DNA, 48 bp, Artificial Sequence
  Description of Artificial Sequence: Synthetic heavy chain variable region CDR H2
tacatccatcacagtgggaacacctactacaacccgtccctcaagagt

SEQ ID NO: 519 - protein, 19 aa, Artificial Sequence
  Description of Artificial Sequence: Synthetic heavy chain variable region CDR H3
ARDLGKPLWDGHYYYGVDV

SEQ ID NO: 520 - DNA, 57 bp, Artificial Sequence
  Description of Artificial Sequence: Synthetic heavy chain variable region CDR H3
gccagagatttgggaaagccgctttgggacggccactattactacggagtggacgtc

SEQ ID NO: 521 - DNA, 327 bp, Artificial Sequence
  Description of Artificial Sequence: Synthetic light chain variable region
gatattgtgatgactcagtctccaggcactctgtctttgtctccaggagaaagagccaccctctcctgcaggaccagtcagaatgttaacagcaactacttagcctggtaccagcataaacctgggcaggctcccaggctcctcatctatggtgcatccagcagggtcactggcatcccagacaggttcagtggcagtgggtctgggacagacttcactctcaccatcaccagagtggagtctgaagattttgcagtgtattactgtcaggtgtatagtagttcacctccgatcaccttcggccaggggaccaaggtggagatcaaa

SEQ ID NO: 522 - protein, 109 aa, Artificial Sequence
  Description of Artificial Sequence: Synthetic light chain variable region
DIVMTQSPGTLSLSPGERATLSCRTSQNVNSNYLAWYQHKPGQAPRLLIYGASSRVTGIPDRFSGSGSGTDFTLTITRVESEDFAVYYCQVYSSSPPITFGQGTKVEIK

SEQ ID NO: 523 - protein, 12 aa, Artificial Sequence
  Description of Artificial Sequence: Synthetic light chain variable region CDR L1
RTSQNVNSNYLA

SEQ ID NO: 524 - DNA, 36 bp, Artificial Sequence
  Description of Artificial Sequence: Synthetic light chain variable region CDR L1
aggaccagtcagaatgttaacagcaactacttagcc

SEQ ID NO: 525 - protein, 7 aa, Artificial Sequence
  Description of Artificial Sequence: Synthetic light chain variable region CDR L2
GASSRVT

SEQ ID NO: 526 - DNA, 21 bp, Artificial Sequence
  Description of Artificial Sequence: Synthetic light chain variable region CDR L2
ggtgcatccagcagggtcact

SEQ ID NO: 527 - protein, 10 aa, Artificial Sequence
  Description of Artificial Sequence: Synthetic light chain variable region CDR L3
QVYSSSPPIT

SEQ ID NO: 528 - DNA, 30 bp, Artificial Sequence
  Description of Artificial Sequence: Synthetic light chain variable region CDR L3
caggtgtatagtagttcacctccgatcacc

SEQ ID NO: 529 - DNA, 375 bp, Artificial Sequence
  Description of Artificial Sequence: Synthetic heavy chain variable region
caggtccagcttgtgcagtctggggctgaggtgaagaagcctgggtcctcggtgaaggtctcctgcaaggcttctggaggcaccttcagcagttatgctatcagctgggtgcgtcaggccccaggacaagggcttgagtggatgggaggaatcatccctatgtttgatatagtcgactacgcacagaagttccagggcagagtcacgattaccgcggacgaatccacgaacacagcctacatggagctgaccagcctgagatctgaggacacggccgtgtattactgtgcgagaactgcggctttaggaccacctgggactatagtggggtacatggacgtctggggcaaagggaccacggtcaccgtctcctca

SEQ ID NO: 530 - protein, 125 aa, Artificial Sequence
  Description of Artificial Sequence: Synthetic heavy chain variable region
QVQLVQSGAEVKKPGSSVKVSCKASGGTFSSYAISWVRQAPGQGLEWMGGIIPMFDIVDYAQKFQGRVTITADESTNTAYMELTSLRSEDTAVYYCARTAALGPPGTIVGYMDVWGKGTTVTVSS

SEQ ID NO: 531 - protein, 9 aa, Artificial Sequence
  Description of Artificial Sequence: Synthetic heavy chain variable region CDR H1
GTFSSYAIS

SEQ ID NO: 532 - DNA, 27 bp, Artificial Sequence
  Description of Artificial Sequence: Synthetic heavy chain variable region CDR H1
ggcaccttcagcagttatgctatcagc

SEQ ID NO: 533 - protein, 17 aa, Artificial Sequence
  Description of Artificial Sequence: Synthetic heavy chain variable region CDR H2
GIIPMFDIVDYAQKFQG

SEQ ID NO: 534 - DNA, 51 bp, Artificial Sequence
  Description of Artificial Sequence: Synthetic heavy chain variable region CDR H2
ggaatcatccctatgtttgatatagtcgactacgcacagaagttccagggc

SEQ ID NO: 535 - protein, 18 aa, Artificial Sequence
  Description of Artificial Sequence: Synthetic heavy chain variable region CDR H3
ARTAALGPPGTIVGYMDV

SEQ ID NO: 536 - DNA, 54 bp, Artificial Sequence
  Description of Artificial Sequence: Synthetic heavy chain variable region CDR H3
gcgagaactgcggctttaggaccacctgggactatagtggggtacatggacgtc

SEQ ID NO: 537 - DNA, 336 bp, Artificial Sequence
  Description of Artificial Sequence: Synthetic light chain variable region
gatattgtgatgacgcagtctccactctccctgcccgtcacccctggagagccggcctccatctcctgccggtctagtcagagcctcctgcaaagtaatggatacaactatttggattggtacctgcagaagccagggcaggctccacagctcctgatctatttgggttctaatcgggcctccggggtccctgacaagttcagtggcagtggatcaggcacagattttacactgaaaatcagcagagtggaggctgaggatgttggggtttattactgcatgcaaactctacaaactccgtggacgttcggccaagggaccaaggtggaaatcaaa

SEQ ID NO: 538 - protein, 112 aa, Artificial Sequence
  Description of Artificial Sequence: Synthetic light chain variable region
DIVMTQSPLSLPVTPGEPASISCRSSQSLLQSNGYNYLDWYLQKPGQAPQLLIYLGSNRASGVPDKFSGSGSGTDFTLKISRVEAEDVGVYYCMQTLQTPWTFGQGTKVEIK

SEQ ID NO: 539 - protein, 16 aa, Artificial Sequence
  Description of Artificial Sequence: Synthetic light chain variable region CDR L1
RSSQSLLQSNGYNYLD

SEQ ID NO: 540 - DNA, 48 bp, Artificial Sequence
  Description of Artificial Sequence: Synthetic light chain variable region CDR L1
cggtctagtcagagcctcctgcaaagtaatggatacaactatttggat

SEQ ID NO: 541 - protein, 7 aa, Artificial Sequence
  Description of Artificial Sequence: Synthetic light chain variable region CDR L2
LGSNRAS

SEQ ID NO: 542 - DNA, 21 bp, Artificial Sequence
  Description of Artificial Sequence: Synthetic light chain variable region CDR L2
ttgggttctaatcgggcctcc

SEQ ID NO: 543 - protein, 9 aa, Artificial Sequence
  Description of Artificial Sequence: Synthetic light chain variable region CDR L3
MQTLQTPWT

SEQ ID NO: 544 - DNA, 27 bp, Artificial Sequence
  Description of Artificial Sequence: Synthetic light chain variable region CDR L3
atgcaaactctacaaactccgtggacg

SEQ ID NO: 545 - DNA, 357 bp, Artificial Sequence
  Description of Artificial Sequence: Synthetic heavy chain variable region
caggtgcagctggtggagtctggagcagaggcgagaaagcccggggagtctctgaagatctcctgtaaggcttctggatacagctttaccaattattggatcggctgggtgcgccagatgcccgggaaaggcctggagtggatgggggtcatctatcctgctgactccgataccagatatagcccgtccttcaaaggccaggtcaccatctcagccgacaaatccatcagcaccgcctacctccagtggaccagactgaaggcctcggacaccgccgtgtatttctgtgcgagacttggaataggagctgctgcccggaactactggggccagggaaccctggtcaccgtctcttca

SEQ ID NO: 546 - protein, 119 aa, Artificial Sequence
  Description of Artificial Sequence: Synthetic heavy chain variable region
QVQLVESGAEARKPGESLKISCKASGYSFTNYWIGWVRQMPGKGLEWMGVIYPADSDTRYSPSFKGQVTISADKSISTAYLQWTRLKASDTAVYFCARLGIGAAARNYWGQGTLVTVSS

SEQ ID NO: 547 - protein, 9 aa, Artificial Sequence
  Description of Artificial Sequence: Synthetic heavy chain variable region CDR H1
YSFTNYWIG

SEQ ID NO: 548 - DNA, 27 bp, Artificial Sequence
  Description of Artificial Sequence: Synthetic heavy chain variable region CDR H1
tacagctttaccaattattggatcggc

SEQ ID NO: 549 - protein, 17 aa, Artificial Sequence
  Description of Artificial Sequence: Synthetic heavy chain variable region CDR H2
VIYPADSDTRYSPSFKG

SEQ ID NO: 550 - DNA, 51 bp, Artificial Sequence
  Description of Artificial Sequence: Synthetic heavy chain variable region CDR H2
gtcatctatcctgctgactccgataccagatatagcccgtccttcaaaggc

SEQ ID NO: 551 - protein, 12 aa, Artificial Sequence
  Description of Artificial Sequence: Synthetic heavy chain variable region CDR H3
ARLGIGAAARNY

SEQ ID NO: 552 - DNA, 36 bp, Artificial Sequence
  Description of Artificial Sequence: Synthetic heavy chain variable region CDR H3
gcgagacttggaataggagctgctgcccggaactac

SEQ ID NO: 553 - DNA, 321 bp, Artificial Sequence
  Description of Artificial Sequence: Synthetic light chain variable region
gacatccaggtgacccagtctccatcctccctgtctgcatctgtaggagacagagtcaccatcacttgccaggcgagtcaggacattagcgacagtttaaattggtatcagcagaaaccagggaaagcccctaacctcctgatctacgatgcatccaagtcggaaacaggggtcccatcaagattcagtggaagcggatctgggacagatttcactttcaccatcagtagcctgcagcctgaagatcttgcaacatattactgtctacagtttgataatctccctccgaccttcggccaagggacacgactggagattaaa

SEQ ID NO: 554 - protein, 107 aa, Artificial Sequence
  Description of Artificial Sequence: Synthetic light chain variable region
DIQVTQSPSSLSASVGDRVTITCQASQDISDSLNWYQQKPGKAPNLLIYDASKSETGVPSRFSGSGSGTDFTFTISSLQPEDLATYYCLQFDNLPPTFGQGTRLEIK

SEQ ID NO: 555 - protein, 11 aa, Artificial Sequence
  Description of Artificial Sequence: Synthetic light chain variable region CDR L1
QASQDISDSLN

SEQ ID NO: 556 - DNA, 33 bp, Artificial Sequence
  Description of Artificial Sequence: Synthetic light chain variable region CDR L1
caggcgagtcaggacattagcgacagtttaaat

SEQ ID NO: 557 - protein, 7 aa, Artificial Sequence
  Description of Artificial Sequence: Synthetic light chain variable region CDR L2
DASKSET

SEQ ID NO: 558 - DNA, 21 bp, Artificial Sequence
  Description of Artificial Sequence: Synthetic light chain variable region CDR L2
gatgcatccaagtcggaaaca

SEQ ID NO: 559 - protein, 9 aa, Artificial Sequence
  Description of Artificial Sequence: Synthetic light chain variable region CDR L3
LQFDNLPPT

SEQ ID NO: 560 - DNA, 27 bp, Artificial Sequence
  Description of Artificial Sequence: Synthetic light chain variable region CDR L3
ctacagtttgataatctccctccgacc

SEQ ID NO: 561 - DNA, 366 bp, Artificial Sequence
  Description of Artificial Sequence: Synthetic heavy chain variable region
gaggtgcagctggtggagtctgggggaggcctggtcaagcctgggggggccctgagactctcctgtgcagcctctggattcagcttcaggagctatagcatgaactgggtccgccaggctccagggaaggggctggagtgggtctcatccattagtagtagtagtaattacataaactacgcagactcagtgaagggccgattcagcatctccagagacaacgccaagaactcactgtatctgcaaatgaacagcctgagagccgaggacacggctgtctattactgtgcgagagatttgttacccgtcgagcggggtcccgcttttgatatctggggccaagggacaatggtcaccgtctcttca

SEQ ID NO: 562 - protein, 122 aa, Artificial Sequence
  Description of Artificial Sequence: Synthetic heavy chain variable region
EVQLVESGGGLVKPGGALRLSCAASGFSFRSYSMNWVRQAPGKGLEWVSSISSSSNYINYADSVKGRFSISRDNAKNSLYLQMNSLRAEDTAVYYCARDLLPVERGPAFDIWGQGTMVTVSS

SEQ ID NO: 563 - protein, 9 aa, Artificial Sequence
  Description of Artificial Sequence: Synthetic heavy chain variable region CDR H1
FSFRSYSMN

SEQ ID NO: 564 - DNA, 27 bp, Artificial Sequence
  Description of Artificial Sequence: Synthetic heavy chain variable region CDR H1
ttcagcttcaggagctatagcatgaac

SEQ ID NO: 565 - protein, 17 aa, Artificial Sequence
  Description of Artificial Sequence: Synthetic heavy chain variable region CDR H2
SISSSSNYINYADSVKG

SEQ ID NO: 566 - DNA, 51 bp, Artificial Sequence
  Description of Artificial Sequence: Synthetic heavy chain variable region CDR H2
tccattagtagtagtagtaattacataaactacgcagactcagtgaagggc

SEQ ID NO: 567 - protein, 15 aa, Artificial Sequence
  Description of Artificial Sequence: Synthetic heavy chain variable region CDR H3
ARDLLPVERGPAFDI

SEQ ID NO: 568 - DNA, 45 bp, Artificial Sequence
  Description of Artificial Sequence: Synthetic heavy chain variable region CDR H3
gcgagagatttgttacccgtcgagcggggtcccgcttttgatatc

SEQ ID NO: 569 - DNA, 333 bp, Artificial Sequence
  Description of Artificial Sequence: Synthetic light chain variable region
tcctatgagctgacacagccaccctcagtgtctggggccccagggcagagggtcaccatctcctgcactgggagcagctccaacatcggggcaggttatgatgtacactggttccagcagcttccaggagcagcccccaaactcctcatctatgctaacagcaatcggccctcaggggtccctgaccgattctctggctccaagtctggcacctcagcctccctggccatcactgggctccaggctgaggatgaggctgattattactgccagtcctatgacagcagactgggtggttcggtattcggcggagggaccaaggtgaccgtccta

SEQ ID NO: 570 - protein, 111 aa, Artificial Sequence
  Description of Artificial Sequence: Synthetic light chain variable region
SYELTQPPSVSGAPGQRVTISCTGSSSNIGAGYDVHWFQQLPGAAPKLLIYANSNRPSGVPDRFSGSKSGTSASLAITGLQAEDEADYYCQSYDSRLGGSVFGGGTKVTVL

SEQ ID NO: 571 - protein, 14 aa, Artificial Sequence
  Description of Artificial Sequence: Synthetic light chain variable region CDR L1
TGSSSNIGAGYDVH

SEQ ID NO: 572 - DNA, 42 bp, Artificial Sequence
  Description of Artificial Sequence: Synthetic light chain variable region CDR L1
actgggagcagctccaacatcggggcaggttatgatgtacac

SEQ ID NO: 573 - protein, 7 aa, Artificial Sequence
  Description of Artificial Sequence: Synthetic light chain variable region CDR L2
ANSNRPS

SEQ ID NO: 574 - DNA, 21 bp, Artificial Sequence
  Description of Artificial Sequence: Synthetic light chain variable region CDR L2
gctaacagcaatcggccctca

SEQ ID NO: 575 - protein, 11 aa, Artificial Sequence
  Description of Artificial Sequence: Synthetic light chain variable region CDR L3
QSYDSRLGGSV

SEQ ID NO: 576 - DNA, 33 bp, Artificial Sequence
  Description of Artificial Sequence: Synthetic light chain variable region CDR L3
cagtcctatgacagcagactgggtggttcggta

SEQ ID NO: 577 - DNA, 384 bp, Artificial Sequence
  Description of Artificial Sequence: Synthetic heavy chain variable region
caggtccagcttgtgcagtctggaccagaggtgaaaaagcccggggagtctctgacgatctcctgtaagggttctggatacgacttttccaataactggatcggctgggtgcgccagatgcccgggaaaggcctggagtggatgggaatcatctatcctggtgactctgataccagatacagcccgtcgttccaaggccaggtcaccctctcagtcgacaagtccattagtaccgcctacctacagtggaggagcctgaaggcctcggacagcggcatctactactgtgcgagacaaattggcggtttggtttgtagcagtgagagctgctacttctacggcatggacgtctggggccaagggaccacggtcaccgtctcctca

SEQ ID NO: 578 - protein, 128 aa, Artificial Sequence
  Description of Artificial Sequence: Synthetic heavy chain variable region
QVQLVQSGPEVKKPGESLTISCKGSGYDFSNNWIGWVRQMPGKGLEWMGIIYPGDSDTRYSPSFQGQVTLSVDKSISTAYLQWRSLKASDSGIYYCARQIGGLVCSSESCYFYGMDVWGQGTTVTVSS

SEQ ID NO: 579 - protein, 9 aa, Artificial Sequence
  Description of Artificial Sequence: Synthetic heavy chain variable region CDR H1
YDFSNNWIG

SEQ ID NO: 580 - DNA, 27 bp, Artificial Sequence
  Description of Artificial Sequence: Synthetic heavy chain variable region CDR H1
tacgacttttccaataactggatcggc

SEQ ID NO: 581 - protein, 17 aa, Artificial Sequence
  Description of Artificial Sequence: Synthetic heavy chain variable region CDR H2
IIYPGDSDTRYSPSFQG

SEQ ID NO: 582 - DNA, 51 bp, Artificial Sequence
  Description of Artificial Sequence: Synthetic heavy chain variable region CDR H2
atcatctatcctggtgactctgataccagatacagcccgtcgttccaaggc

SEQ ID NO: 583 - protein, 21 aa, Artificial Sequence
  Description of Artificial Sequence: Synthetic heavy chain variable region CDR H3
ARQIGGLVCSSESCYFYGMDV

SEQ ID NO: 584 - DNA, 63 bp, Artificial Sequence
  Description of Artificial Sequence: Synthetic heavy chain variable region CDR H3
gcgagacaaattggcggtttggtttgtagcagtgagagctgctacttctacggcatggacgtc

SEQ ID NO: 585 - DNA, 321 bp, Artificial Sequence
  Description of Artificial Sequence: Synthetic light chain variable region
gacatccagttgacccagtctccatcctccctgtctgcatctgtgggaggcagagtgaccatcacttgccgggcaagtcagagcattagcaactatttaaattggtatcaacacaaaccggggaaagcccctgaactcctgatctatggtgcatccagtttgcaaagtggggtcccatcaaggttcagtggcagtggatctgggacagacttcactctcaccatcagcagtctgcaacctgaagattttgcaacttactactgtcaacagagtgacactaccccgttcactttcggccaggggaccaaagtggatatcaaa

SEQ ID NO: 586 - protein, 107 aa, Artificial Sequence
  Description of Artificial Sequence: Synthetic light chain variable region
DIQLTQSPSSLSASVGGRVTITCRASQSISNYLNWYQHKPGKAPELLIYGASSLQSGVPSRFSGSGSGTDFTLTISSLQPEDFATYYCQQSDTTPFTFGQGTKVDIK

SEQ ID NO: 587 - protein, 11 aa, Artificial Sequence
  Description of Artificial Sequence: Synthetic light chain variable region CDR L1
RASQSISNYLN

SEQ ID NO: 588 - DNA, 33 bp, Artificial Sequence
  Description of Artificial Sequence: Synthetic light chain variable region CDR L1
cgggcaagtcagagcattagcaactatttaaat

SEQ ID NO: 589 - protein, 7 aa, Artificial Sequence
  Description of Artificial Sequence: Synthetic light chain variable region CDR L2
GASSLQS

SEQ ID NO: 590 - DNA, 21 bp, Artificial Sequence
  Description of Artificial Sequence: Synthetic light chain variable region CDR L2
ggtgcatccagtttgcaaagt

SEQ ID NO: 591 - protein, 9 aa, Artificial Sequence
  Description of Artificial Sequence: Synthetic light chain variable region CDR L3
QQSDTTPFT

SEQ ID NO: 592 - DNA, 27 bp, Artificial Sequence
  Description of Artificial Sequence: Synthetic light chain variable region CDR L3
caacagagtgacactaccccgttcact

SEQ ID NO: 593 - DNA, 387 bp, Artificial Sequence
  Description of Artificial Sequence: Synthetic heavy chain variable region
caggtccagctggtgcagtctgggggaggcttggtaaagccgggggggtcccttagactctcctgtgcagcctctggattcactttcagtaaggcctggatgaactgggtccgccaggctccagggaaggggctggagtgggttggccgtattagaagcaaaactgatggtgggacagcagactacgcggcacccgtgaaaggcagattcaccatgtcaagagatgattcaaaaaacacgctgtatttgcaaatgaacagcctgaaaaccgaggacacagccgtgtattactgtgccacagattctcgccgactctatgatagtcgtggtttttattcaagtgcttttgatgtctggggccaagggaccacggtcaccgtctcctca

SEQ ID NO: 594 - protein, 129 aa, Artificial Sequence
  Description of Artificial Sequence: Synthetic heavy chain variable region
QVQLVQSGGGLVKPGGSLRLSCAASGFTFSKAWMNWVRQAPGKGLEWVGRIRSKTDGGTADYAAPVKGRFTMSRDDSKNTLYLQMNSLKTEDTAVYYCATDSRRLYDSRGFYSSAFDVWGQGTTVTVSS

SEQ ID NO: 595 - protein, 9 aa, Artificial Sequence
  Description of Artificial Sequence: Synthetic heavy chain variable region CDR H1
FTFSKAWMN

SEQ ID NO: 596 - DNA, 27 bp, Artificial Sequence
  Description of Artificial Sequence: Synthetic heavy chain variable region CDR H1
ttcactttcagtaaggcctggatgaac

SEQ ID NO: 597 - protein, 19 aa, Artificial Sequence
  Description of Artificial Sequence: Synthetic heavy chain variable region CDR H2
RIRSKTDGGTADYAAPVKG

SEQ ID NO: 598 - DNA, 57 bp, Artificial Sequence
  Description of Artificial Sequence: Synthetic heavy chain variable region CDR H2
cgtattagaagcaaaactgatggtgggacagcagactacgcggcacccgtgaaaggc

SEQ ID NO: 599 - protein, 20 aa, Artificial Sequence
  Description of Artificial Sequence: Synthetic heavy chain variable region CDR H3
ATDSRRLYDSRGFYSSAFDV

SEQ ID NO: 600 - DNA, 60 bp, Artificial Sequence
  Description of Artificial Sequence: Synthetic heavy chain variable region CDR H3
gccacagattctcgccgactctatgatagtcgtggtttttattcaagtgcttttgatgtc

SEQ ID NO: 601 - DNA, 333 bp, Artificial Sequence
  Description of Artificial Sequence: Synthetic light chain variable region
cagtctgtcctgacgcagccgccctcagtgtctggggccccagggcagagggtcaccatctcctgcactgggagcagctccaacatcggggcgggttatgatgtacactggtaccaacaccttccaggaacagcccccaaagtcctcatctatggtaacaacaatcggccctcaggggtccctgaccgattctctggctccaagtctggcacctcagcctccctggccatcactgggctccaggctgaggatgaggctgattattactgccagtcctatgacgacagcctgactggttgggtgttcggcggagggaccaaggtcaccgtccta

SEQ ID NO: 602 - protein, 111 aa, Artificial Sequence
  Description of Artificial Sequence: Synthetic light chain variable region
QSVLTQPPSVSGAPGQRVTISCTGSSSNIGAGYDVHWYQHLPGTAPKVLIYGNNNRPSGVPDRFSGSKSGTSASLAITGLQAEDEADYYCQSYDDSLTGWVFGGGTKVTVL

SEQ ID NO: 603 - protein, 14 aa, Artificial Sequence
  Description of Artificial Sequence: Synthetic light chain variable region CDR L1
TGSSSNIGAGYDVH

SEQ ID NO: 604 - DNA, 42 bp, Artificial Sequence
  Description of Artificial Sequence: Synthetic light chain variable region CDR L1
actgggagcagctccaacatcggggcgggttatgatgtacac

SEQ ID NO: 605 - protein, 7 aa, Artificial Sequence
  Description of Artificial Sequence: Synthetic light chain variable region CDR L2
GNNNRPS

SEQ ID NO: 606 - DNA, 21 bp, Artificial Sequence
  Description of Artificial Sequence: Synthetic light chain variable region CDR L2
ggtaacaacaatcggccctca

SEQ ID NO: 607 - protein, 11 aa, Artificial Sequence
  Description of Artificial Sequence: Synthetic light chain variable region CDR L3
QSYDDSLTGWV

SEQ ID NO: 608 - DNA, 33 bp, Artificial Sequence
  Description of Artificial Sequence: Synthetic light chain variable region CDR L3
cagtcctatgacgacagcctgactggttgggtg

SEQ ID NO: 609 - DNA, 384 bp, Artificial Sequence
  Description of Artificial Sequence: Synthetic heavy chain variable region
caggtgcagctggtgcaatctggaccagaggtgaaaaagcccggggagtctctgacgatctcctgtaagggttctggatacgacttttccaataactggatcggctgggtgcgccagatgcccgggaaaggcctggagtggatgggaatcatctatcctggtgactctgataccagatacagcccgtcgttccaaggccaggtcaccctctcagtcgacaagtccattagtaccgcctacctacagtggaggagcctgaaggcctcggacagcggcatctactactgtgcgagacaaattggcggtttggtttgtagcagtgagagctgctacttctacggcatggacgtctggggccaagggaccacggtcaccgtctcctca

SEQ ID NO: 610 - protein, 128 aa, Artificial Sequence; identical to SEQ ID NO: 578
  Description of Artificial Sequence: Synthetic heavy chain variable region

SEQ ID NO: 611 - protein, 9 aa, Artificial Sequence
  Description of Artificial Sequence: Synthetic heavy chain variable region CDR H1
YDFSNNWIG

SEQ ID NO: 612 - DNA, 27 bp, Artificial Sequence
  Description of Artificial Sequence: Synthetic heavy chain variable region CDR H1
tacgacttttccaataactggatcggc

SEQ ID NO: 613 - protein, 17 aa, Artificial Sequence
  Description of Artificial Sequence: Synthetic heavy chain variable region CDR H2
IIYPGDSDTRYSPSFQG

SEQ ID NO: 614 - DNA, 51 bp, Artificial Sequence; identical to SEQ ID NO: 582
  Description of Artificial Sequence: Synthetic heavy chain variable region CDR H2

SEQ ID NO: 615 - protein, 21 aa, Artificial Sequence
  Description of Artificial Sequence: Synthetic heavy chain variable region CDR H3
ARQIGGLVCSSESCYFYGMDV

SEQ ID NO: 616 - DNA, 63 bp, Artificial Sequence; identical to SEQ ID NO: 584
  Description of Artificial Sequence: Synthetic heavy chain variable region CDR H3

SEQ ID NO: 617 - DNA, 321 bp, Artificial Sequence
  Description of Artificial Sequence: Synthetic light chain variable region
gacatccgggtgacccagtctccatcctccctgtctgcatctgtgggaggcagagtgaccatcacttgccgggcaagtcagagcattagcaactatttaaattggtatcaacacaaaccggggaaagcccctgaactcctgatctatggtgcatccagtttgcaaagtggggtcccatcaaggttcagtggcagtggatctgggacagacttcactctcaccatcagcagtctgcaacctgaagattttgcaacttactactgtcaacagagtgacactaccccgttcactttcggccaggggaccaagctggagatcaaa

SEQ ID NO: 618 - protein, 107 aa, Artificial Sequence
  Description of Artificial Sequence: Synthetic light chain variable region
DIRVTQSPSSLSASVGGRVTITCRASQSISNYLNWYQHKPGKAPELLIYGASSLQSGVPSRFSGSGSGTDFTLTISSLQPEDFATYYCQQSDTTPFTFGQGTKLEIK

SEQ ID NO: 619 - protein, 11 aa, Artificial Sequence
  Description of Artificial Sequence: Synthetic light chain variable region CDR L1
RASQSISNYLN

SEQ ID NO: 620 - DNA, 33 bp, Artificial Sequence; identical to SEQ ID NO: 588
  Description of Artificial Sequence: Synthetic light chain variable region CDR L1

SEQ ID NO: 621 - protein, 7 aa, Artificial Sequence
  Description of Artificial Sequence: Synthetic light chain variable region CDR L2
GASSLQS

SEQ ID NO: 622 - DNA, 21 bp, Artificial Sequence
  Description of Artificial Sequence: Synthetic light chain variable region CDR L2
ggtgcatccagtttgcaaagt

SEQ ID NO: 623 - protein, 9 aa, Artificial Sequence
  Description of Artificial Sequence: Synthetic light chain variable region CDR L3
QQSDTTPFT

SEQ ID NO: 624 - DNA, 27 bp, Artificial Sequence
  Description of Artificial Sequence: Synthetic light chain variable region CDR L3
caacagagtgacactaccccgttcact

SEQ ID NO: 625 - DNA, 369 bp, Artificial Sequence
  Description of Artificial Sequence: Synthetic heavy chain variable region
gaggtgcagctggtggagtctgggggaggcctggtcaagcctggggggtccctgagactctcttgtgcagcctctggattcaccttcagtagttttggcatgcattgggtccgccaggctccagggcagggactggagtgggtcgcatccattactggtggcagcagttacataaactacgcagactcagtgaagggccgattcaccatctccagagacaacgccaagaagtcactgtctctgcaaatgaagaacctgagagccgaggacacggctgagtattactgtgtgcgaggagtcctaccaggtgatactggggggggctggttcgactcctggggccagggaaccctggtcaccgtctcctca

SEQ ID NO: 626 - protein, 123 aa, Artificial Sequence
  Description of Artificial Sequence: Synthetic heavy chain variable region
EVQLVESGGGLVKPGGSLRLSCAASGFTFSSFGMHWVRQAPGQGLEWVASITGGSSYINYADSVKGRFTISRDNAKKSLSLQMKNLRAEDTAEYYCVRGVLPGDTGGGWFDSWGQGTLVTVSS

SEQ ID NO: 627 - protein, 9 aa, Artificial Sequence
  Description of Artificial Sequence: Synthetic heavy chain variable region CDR H1
FTFSSFGMH

SEQ ID NO: 628 - DNA, 27 bp, Artificial Sequence
  Description of Artificial Sequence: Synthetic heavy chain variable region CDR H1
ttcaccttcagtagttttggcatgcat

SEQ ID NO: 629 - protein, 17 aa, Artificial Sequence
  Description of Artificial Sequence: Synthetic heavy chain variable region CDR H2
SITGGSSYINYADSVKG

SEQ ID NO: 630 - DNA, 51 bp, Artificial Sequence; identical to SEQ ID NO: 502
  Description of Artificial Sequence: Synthetic heavy chain variable region CDR H2

SEQ ID NO: 631 - protein, 16 aa, Artificial Sequence
  Description of Artificial Sequence: Synthetic heavy chain variable region CDR H3
VRGVLPGDTGGGWFDS

SEQ ID NO: 632 - DNA, 48 bp, Artificial Sequence
  Description of Artificial Sequence: Synthetic heavy chain variable region CDR H3
gtgcgaggagtcctaccaggtgatactggggggggctggttcgactcc

SEQ ID NO: 633 - DNA, 330 bp, Artificial Sequence
  Description of Artificial Sequence: Synthetic light chain variable region
cagtctgtgctgacgcagccgccctcaatgtctggggccccagggcagagggtcaccatctcctgcactgggaccagctccaacatcggggcgggttatgatgtacagtggtatcagcagtttccaggaacagcccccaaactcctcatctctggtaacaacaatcggccctcaggggtccctgaccgattctctggctccaagtctggcgcctcagcctccctggccatcactgggctccaggctgaggatgaggctgattattactgccagtcctatgactacagcctgaattgggtgttcggcggagggaccaagctgaccgtccta

SEQ ID NO: 634 - protein, 110 aa, Artificial Sequence; identical to SEQ ID NO: 506
  Description of Artificial Sequence: Synthetic light chain variable region

SEQ ID NO: 635 - protein, 14 aa, Artificial Sequence
  Description of Artificial Sequence: Synthetic light chain variable region CDR L1
TGTSSNIGAGYDVQ

SEQ ID NO: 636 - DNA, 42 bp, Artificial Sequence; identical to SEQ ID NO: 508
  Description of Artificial Sequence: Synthetic light chain variable region CDR L1

SEQ ID NO: 637 - protein, 7 aa, Artificial Sequence
  Description of Artificial Sequence: Synthetic light chain variable region CDR L2
GNNNRPS

SEQ ID NO: 638 - DNA, 21 bp, Artificial Sequence
  Description of Artificial Sequence: Synthetic light chain variable region CDR L2
ggtaacaacaatcggccctca

SEQ ID NO: 639 - protein, 10 aa, Artificial Sequence
  Description of Artificial Sequence: Synthetic light chain variable region CDR L3
QSYDYSLNWV

SEQ ID NO: 640 - DNA, 30 bp, Artificial Sequence; identical to SEQ ID NO: 512
  Description of Artificial Sequence: Synthetic light chain variable region CDR L3

SEQ ID NO: 641 - DNA, 360 bp, Artificial Sequence
  Description of Artificial Sequence: Synthetic heavy chain variable region
caggtccagcttgtacagtctggagcagaggtgaaaaagcccggggagtctctgaagatctcctgtaagggttctggatacagctttagcagtttctggatcggctgggtgcgccagatgcccgggaaaggcctggagtggatgggcatcatatatcctggtgactctgataccagatatagcccgtctttccaaggccaggtcaccatgtcagccgacacgtccataaacaccgcctacctgcagtggaacagcgtgaaggcctcggacaccgccatttattactgtgcgagacttccagttggtagttattattacttcaatctctggggccgtggcaccctggtcaccgtctcctca

SEQ ID NO: 642 - protein, 120 aa, Artificial Sequence
  Description of Artificial Sequence: Synthetic heavy chain variable region
QVQLVQSGAEVKKPGESLKISCKGSGYSFSSFWIGWVRQMPGKGLEWMGIIYPGDSDTRYSPSFQGQVTMSADTSINTAYLQWNSVKASDTAIYYCARLPVGSYYYFNLWGRGTLVTVSS

SEQ ID NO: 643 - protein, 9 aa, Artificial Sequence
  Description of Artificial Sequence: Synthetic heavy chain variable region CDR H1
YSFSSFWIG

SEQ ID NO: 644 - DNA, 27 bp, Artificial Sequence
  Description of Artificial Sequence: Synthetic heavy chain variable region CDR H1
tacagctttagcagtttctggatcggc

SEQ ID NO: 645 - protein, 17 aa, Artificial Sequence
  Description of Artificial Sequence: Synthetic heavy chain variable region CDR H2
IIYPGDSDTRYSPSFQG

SEQ ID NO: 646 - DNA, 51 bp, Artificial Sequence
  Description of Artificial Sequence: Synthetic heavy chain variable region CDR H2
atcatatatcctggtgactctgataccagatatagcccgtctttccaaggc

SEQ ID NO: 647 - protein, 13 aa, Artificial Sequence
  Description of Artificial Sequence: Synthetic heavy chain variable region CDR H3
ARLPVGSYYYFNL

SEQ ID NO: 648 - DNA, 39 bp, Artificial Sequence
  Description of Artificial Sequence: Synthetic heavy chain variable region CDR H3
gcgagacttccagttggtagttattattacttcaatctc

SEQ ID NO: 649 - DNA, 324 bp, Artificial Sequence
  Description of Artificial Sequence: Synthetic light chain variable region
gaaattgtgatgacacagtctccagccaccctgtctgtgtctccaggggaaagcgccaccctattttgcagggccagtcagagtattagtagcgacttagcctggtaccagcagagacctggccaggctcccaggctcctcatctatgatgcatccaccagggccactggtgtccctgccaggttcagtgccactgggtctgaggcagagttcactctcaccatcagcggcctgcagtctgaagattttgcagtttattactgtcagcagtataataactggctttcgtggacgttcggccaagggaccaagctggagatcaaa

SEQ ID NO: 650 - protein, 108 aa, Artificial Sequence
  Description of Artificial Sequence: Synthetic light chain variable region
EIVMTQSPATLSVSPGESATLFCRASQSISSDLAWYQQRPGQAPRLLIYDASTRATGVPARFSATGSEAEFTLTISGLQSEDFAVYYCQQYNNWLSWTFGQGTKLEIK

SEQ ID NO: 651 - protein, 11 aa, Artificial Sequence
  Description of Artificial Sequence: Synthetic light chain variable region CDR L1
RASQSISSDLA

SEQ ID NO: 652 - DNA, 33 bp, Artificial Sequence
  Description of Artificial Sequence: Synthetic light chain variable region CDR L1
agggccagtcagagtattagtagcgacttagcc

SEQ ID NO: 653 - protein, 7 aa, Artificial Sequence
  Description of Artificial Sequence: Synthetic light chain variable region CDR L2
DASTRAT

SEQ ID NO: 654 - DNA, 21 bp, Artificial Sequence
  Description of Artificial Sequence: Synthetic light chain variable region CDR L2
gatgcatccaccagggccact

SEQ ID NO: 655 - protein, 10 aa, Artificial Sequence
  Description of Artificial Sequence: Synthetic light chain variable region CDR L3
QQYNNWLSWT

SEQ ID NO: 656 - DNA, 30 bp, Artificial Sequence
  Description of Artificial Sequence: Synthetic light chain variable region CDR L3
cagcagtataataactggctttcgtggacg

SEQ ID NO: 657 - DNA, 360 bp, Artificial Sequence
  Description of Artificial Sequence: Synthetic heavy chain variable region
caggtgcagctgcaggagtcgggcccaggactggagaagccttcacagaccctgtccctcacctgcactgtctctcgtggctccatcagaattggtggttacttctggagttggatccgccagcacccagggaagggtctggagtggcttggatacatctctaacgatggggccaccgactacaacccgtccctcaggagtcgacttgccatatcagcagacacatctaagaaccagttttccctgaccctgaggtctgtgactgccgcggacacggccatctattactgtgcgagaacttcttatgcagggcgcatgctcgaccgctggggccagggaatcctggtcaccgtctcctca

SEQ ID NO: 658 - protein, 120 aa, Artificial Sequence
  Description of Artificial Sequence: Synthetic heavy chain variable region
QVQLQESGPGLEKPSQTLSLTCTVSRGSIRIGGYFWSWIRQHPGKGLEWLGYISNDGATDYNPSLRSRLAISADTSKNQFSLTLRSVTAADTAIYYCARTSYAGRMLDRWGQGILVTVSS

SEQ ID NO: 659 - protein, 11 aa, Artificial Sequence
  Description of Artificial Sequence: Synthetic heavy chain variable region CDR H1
GSIRIGGYFWS

SEQ ID NO: 660 - DNA, 33 bp, Artificial Sequence
  Description of Artificial Sequence: Synthetic heavy chain variable region CDR H1
ggctccatcagaattggtggttacttctggagt

SEQ ID NO: 661 - protein, 16 aa, Artificial Sequence
  Description of Artificial Sequence: Synthetic heavy chain variable region CDR H2
YISNDGATDYNPSLRS

SEQ ID NO: 662 - DNA, 48 bp, Artificial Sequence
  Description of Artificial Sequence: Synthetic heavy chain variable region CDR H2
tacatctctaacgatggggccaccgactacaacccgtccctcaggagt

SEQ ID NO: 663 - protein, 12 aa, Artificial Sequence
  Description of Artificial Sequence: Synthetic heavy chain variable region CDR H3
ARTSYAGRMLDR

SEQ ID NO: 664 - DNA, 36 bp, Artificial Sequence
  Description of Artificial Sequence: Synthetic heavy chain variable region CDR H3
gcgagaacttcttatgcagggcgcatgctcgaccgc

SEQ ID NO: 665 - DNA, 336 bp, Artificial Sequence
  Description of Artificial Sequence: Synthetic light chain variable region
gacatccgggtgacccagtctccagtctccctgcccgtcacccctggagagccggcctccatctcctgcaggtctagtcagagtctcctgcatagtaatggaaacaactatttggattggtacctgcagaagccagggcagtctccacaactcctgatctatatgggttcttatcgggcctccggggtccctgacaggttcagcggcagtggatcaggcacagattttacactgaaaatcagcagagtggaggctgaggatgttggtgtttattactgcatgcaaggtctacaaattccttggacgttcggccaagggaccaagctggagatcaaa

SEQ ID NO: 666 - protein, 112 aa, Artificial Sequence
  Description of Artificial Sequence: Synthetic light chain variable region
DIRVTQSPVSLPVTPGEPASISCRSSQSLLHSNGNNYLDWYLQKPGQSPQLLIYMGSYRASGVPDRFSGSGSGTDFTLKISRVEAEDVGVYYCMQGLQIPWTFGQGTKLEIK

SEQ ID NO: 667 - protein, 16 aa, Artificial Sequence
  Description of Artificial Sequence: Synthetic light chain variable region CDR L1
RSSQSLLHSNGNNYLD

SEQ ID NO: 668 - DNA, 48 bp, Artificial Sequence
  Description of Artificial Sequence: Synthetic light chain variable region CDR L1
aggtctagtcagagtctcctgcatagtaatggaaacaactatttggat

SEQ ID NO: 669 - protein, 7 aa, Artificial Sequence
  Description of Artificial Sequence: Synthetic light chain variable region CDR L2
MGSYRAS

SEQ ID NO: 670 - DNA, 21 bp, Artificial Sequence
  Description of Artificial Sequence: Synthetic light chain variable region CDR L2
atgggttcttatcgggcctcc

SEQ ID NO: 671 - protein, 9 aa, Artificial Sequence
  Description of Artificial Sequence: Synthetic light chain variable region CDR L3
MQGLQIPWT

SEQ ID NO: 672 - DNA, 27 bp, Artificial Sequence
  Description of Artificial Sequence: Synthetic light chain variable region CDR L3
atgcaaggtctacaaattccttggacg

SEQ ID NO: 673 - DNA, 378 bp, Artificial Sequence
  Description of Artificial Sequence: Synthetic heavy chain variable region
gaggtgcagctgttggagtctgggggaggcgtggtccagcctgggaggtccctcagactctcctgtgcagcctctggattcaccttcagtagctatgccatgcactgggtccgccagactccagacaaggggctggagtgggtggcacttatatccgatgatggaagaaatgaatattatgcagattccgtgcagggccgattcaccatctccagagacaaatccaagaacacgctgcatctggaaatgaacagcctgagagctgaggacacggctgtttattactgtgcgaaagtacgaaatgaggcgtgggagctcctgggtaatgatgatgctcttgatgtctggggccaagggacaatggtcaccgtctcttca

SEQ ID NO: 674 - protein, 126 aa, Artificial Sequence
  Description of Artificial Sequence: Synthetic heavy chain variable region
EVQLLESGGGVVQPGRSLRLSCAASGFTFSSYAMHWVRQTPDKGLEWVALISDDGRNEYYADSVQGRFTISRDKSKNTLHLEMNSLRAEDTAVYYCAKVRNEAWELLGNDDALDVWGQGTMVTVSS

SEQ ID NO: 675 - protein, 9 aa, Artificial Sequence
  Description of Artificial Sequence: Synthetic heavy chain variable region CDR H1
FTFSSYAMH

SEQ ID NO: 676 - DNA, 27 bp, Artificial Sequence
  Description of Artificial Sequence: Synthetic heavy chain variable region CDR H1
ttcaccttcagtagctatgccatgcac

SEQ ID NO: 677 - protein, 17 aa, Artificial Sequence
  Description of Artificial Sequence: Synthetic heavy chain variable region CDR H2
LISDDGRNEYYADSVQG

SEQ ID NO: 678 - DNA, 51 bp, Artificial Sequence
  Description of Artificial Sequence: Synthetic heavy chain variable region CDR H2
cttatatccgatgatggaagaaatgaatattatgcagattccgtgcagggc

SEQ ID NO: 679 - protein, 19 aa, Artificial Sequence
  Description of Artificial Sequence: Synthetic heavy chain variable region CDR H3
AKVRNEAWELLGNDDALDV

SEQ ID NO: 680 - DNA, 57 bp, Artificial Sequence
  Description of Artificial Sequence: Synthetic heavy chain variable region CDR H3
gcgaaagtacgaaatgaggcgtgggagctcctgggtaatgatgatgctcttgatgtc

SEQ ID NO: 681 - DNA, 330 bp, Artificial Sequence
  Description of Artificial Sequence: Synthetic light chain variable region
cagtctgtgctgacgcagccgccctcagtgtctgcggccccaggacagaaagtcaccatctcctgctctggaactagcttcaacattggcagtaattacgtatcctggtaccagctactcccaggaacagcccccaaactcctcatttttgacaattataagcgaccctcagggattcctgaccgattctctggctcctggtctggcacgtcagccaccctggccatcagcggactccagactggggacgaggccgaatacttctgcggaacttgggacaccagcctgagagctggagtgttcggcggagggaccaagctcaccgtccta

SEQ ID NO: 682 - protein, 110 aa, Artificial Sequence
  Description of Artificial Sequence: Synthetic light chain variable region
QSVLTQPPSVSAAPGQKVTISCSGTSFNIGSNYVSWYQLLPGTAPKLLIFDNYKRPSGIPDRFSGSWSGTSATLAISGLQTGDEAEYFCGTWDTSLRAGVFGGGTKLTVL

SEQ ID NO: 683 - protein, 13 aa, Artificial Sequence
  Description of Artificial Sequence: Synthetic light chain variable region CDR L1
SGTSFNIGSNYVS

SEQ ID NO: 684 - DNA, 39 bp, Artificial Sequence
  Description of Artificial Sequence: Synthetic light chain variable region CDR L1
tctggaactagcttcaacattggcagtaattacgtatcc

SEQ ID NO: 685 - protein, 7 aa, Artificial Sequence
  Description of Artificial Sequence: Synthetic light chain variable region CDR L2
DNYKRPS

SEQ ID NO: 686 - DNA, 21 bp, Artificial Sequence
  Description of Artificial Sequence: Synthetic light chain variable region CDR L2
gacaattataagcgaccctca

SEQ ID NO: 687 - protein, 11 aa, Artificial Sequence
  Description of Artificial Sequence: Synthetic light chain variable region CDR L3
GTWDTSLRAGV

SEQ ID NO: 688 - DNA, 33 bp, Artificial Sequence
  Description of Artificial Sequence: Synthetic light chain variable region CDR L3
ggaacttgggacaccagcctgagagctggagtg

SEQ ID NO: 689 - DNA, 354 bp, Artificial Sequence
  Description of Artificial Sequence: Synthetic heavy chain variable region
caggtccagctggtgcagtctgggtctgaggtgaagaagcctggggcctcagtgaggctctcctgcaaggttgccggttacagcctcagtgagttatccatgcactgggtgcgacagtctcctggaaaagggcttgagtggttgggagcttttgaccatgaagatgctgaagcaatctatgcaccgaggttccagggcagaatcaccatgaccgcggacacatctacggacacagcctacatggaactgagcagcctgagatctgaggacacggccgtttattactgtgcaacaccgaccccagttggagctacggactactggggccagggaaccctggtcaccgtctcctca

SEQ ID NO: 690 - protein, 118 aa, Artificial Sequence
  Description of Artificial Sequence: Synthetic heavy chain variable region
QVQLVQSGSEVKKPGASVRLSCKVAGYSLSELSMHWVRQSPGKGLEWLGAFDHEDAEAIYAPRFQGRITMTADTSTDTAYMELSSLRSEDTAVYYCATPTPVGATDYWGQGTLVTVSS

SEQ ID NO: 691 - protein, 9 aa, Artificial Sequence
  Description of Artificial Sequence: Synthetic heavy chain variable region CDR H1
YSLSELSMH

SEQ ID NO: 692 - DNA, 27 bp, Artificial Sequence
  Description of Artificial Sequence: Synthetic heavy chain variable region CDR H1
tacagcctcagtgagttatccatgcac

SEQ ID NO: 693 - protein, 17 aa, Artificial Sequence
  Description of Artificial Sequence: Synthetic heavy chain variable region CDR H2
AFDHEDAEAIYAPRFQG

SEQ ID NO: 694 - DNA, 51 bp, Artificial Sequence
  Description of Artificial Sequence: Synthetic heavy chain variable region CDR H2
gcttttgaccatgaagatgctgaagcaatctatgcaccgaggttccagggc

SEQ ID NO: 695 - protein, 11 aa, Artificial Sequence
  Description of Artificial Sequence: Synthetic heavy chain variable region CDR H3
ATPTPVGATDY

SEQ ID NO: 696 - DNA, 33 bp, Artificial Sequence
  Description of Artificial Sequence: Synthetic heavy chain variable region CDR H3
gcaacaccgaccccagttggagctacggactac

SEQ ID NO: 697 - DNA, 321 bp, Artificial Sequence
  Description of Artificial Sequence: Synthetic light chain variable region
gacatccagatgacccagtctccatcctccctgtctgcatctgtaggagacagagtcaccatcacttgccgggcaagtcagagtattagtagttatttaaattggtatcaacaaaaaccaggaaaagcccctaagctcctgatctatgctgcatccagtttgcaaagggggggcccatcaagattcagtggcagtggatctgggacagatttcactctcaccatcagcagtctgcaacctgaagattttgcaacttactattgtcaacagagttacattattccgtacacttttggccaggggaccaaagtggatatcaaa

SEQ ID NO: 698 - protein, 107 aa, Artificial Sequence
  Description of Artificial Sequence: Synthetic light chain variable region
DIQMTQSPSSLSASVGDRVTITCRASQSISSYLNWYQQKPGKAPKLLIYAASSLQRGGPSRFSGSGSGTDFTLTISSLQPEDFATYYCQQSYIIPYTFGQGTKVDIK

SEQ ID NO: 699 - protein, 11 aa, Artificial Sequence
  Description of Artificial Sequence: Synthetic light chain variable region CDR L1
RASQSISSYLN

SEQ ID NO: 700 - DNA, 33 bp, Artificial Sequence
  Description of Artificial Sequence: Synthetic light chain variable region CDR L1
cgggcaagtcagagtattagtagttatttaaat

SEQ ID NO: 701 - protein, 7 aa, Artificial Sequence
  Description of Artificial Sequence: Synthetic light chain variable region CDR L2
AASSLQR

SEQ ID NO: 702 - DNA, 21 bp, Artificial Sequence
  Description of Artificial Sequence: Synthetic light chain variable region CDR L2
gctgcatccagtttgcaaagg

SEQ ID NO: 703 - protein, 9 aa, Artificial Sequence
  Description of Artificial Sequence: Synthetic light chain variable region CDR L3
QQSYIIPYT

SEQ ID NO: 704 - DNA, 27 bp, Artificial Sequence
  Description of Artificial Sequence: Synthetic light chain variable region CDR L3
caacagagttacattattccgtacact

SEQ ID NO: 705 - DNA, 360 bp, Artificial Sequence
  Description of Artificial Sequence: Synthetic heavy chain variable region
caggtgcagctgcaggagtccggcccaggacgggtgaagccttcggagaccctgtccctcacctgcagtgtcgctgatggctcaatcagtagtggtcattactactggggctgggtccgccagcccccagggaaggggctggagtggattgcgacaatccatgatagtggggccacgtactacaacccgtccctccagagtcgagtcaccatatccgtagacacgtccaagaaccagttctccctgaaagtgaattctgtgaccgccgcagacacggctgtctattactgtgcgagtcgaaggggcagtggctggtttttcgactcctggggccagggaaccctggtcaccgtctcctca

SEQ ID NO: 706 - protein, 120 aa, Artificial Sequence
  Description of Artificial Sequence: Synthetic heavy chain variable region
QVQLQESGPGRVKPSETLSLTCSVADGSISSGHYYWGWVRQPPGKGLEWIATIHDSGATYYNPSLQSRVTISVDTSKNQFSLKVNSVTAADTAVYYCASRRGSGWFFDSWGQGTLVTVSS

SEQ ID NO: 707 - protein, 11 aa, Artificial Sequence
  Description of Artificial Sequence: Synthetic heavy chain variable region CDR H1
GSISSGHYYWG

SEQ ID NO: 708 - DNA, 33 bp, Artificial Sequence
  Description of Artificial Sequence: Synthetic heavy chain variable region CDR H1
ggctcaatcagtagtggtcattactactggggc

SEQ ID NO: 709 - protein, 16 aa, Artificial Sequence
  Description of Artificial Sequence: Synthetic heavy chain variable region CDR H2
TIHDSGATYYNPSLQS

SEQ ID NO: 710 - DNA, 48 bp, Artificial Sequence
  Description of Artificial Sequence: Synthetic heavy chain variable region CDR H2
acaatccatgatagtggggccacgtactacaacccgtccctccagagt

SEQ ID NO: 711 - protein, 12 aa, Artificial Sequence
  Description of Artificial Sequence: Synthetic heavy chain variable region CDR H3
ASRRGSGWFFDS

SEQ ID NO: 712 - DNA, 36 bp, Artificial Sequence
  Description of Artificial Sequence: Synthetic heavy chain variable region CDR H3
gcgagtcgaaggggcagtggctggtttttcgactcc

SEQ ID NO: 713 - DNA, 327 bp, Artificial Sequence
  Description of Artificial Sequence: Synthetic light chain variable region
gatattgtgctgactcagtctccagccaccctgtctgtgtctccaggggaaagagtcaccctctcctgcagggccagtcacagtgttaactacaatttagcctggtaccagcagaaacctggtcaggctcccaggctcctcatctatggttcatctaccagggccactggtctcccagccaggttcagtggcagtgggtctgggacagagttcactctcaccatcagcagcctgcagtctgaagattttgcaatttattactgtcagcagtataataactggcctccgggaggcacttttggccaggggaccaaggtggaaatcaaa

SEQ ID NO: 714 - protein, 109 aa, Artificial Sequence
  Description of Artificial Sequence: Synthetic light chain variable region
DIVLTQSPATLSVSPGERVTLSCRASHSVNYNLAWYQQKPGQAPRLLIYGSSTRATGLPARFSGSGSGTEFTLTISSLQSEDFAIYYCQQYNNWPPGGTFGQGTKVEIK

SEQ ID NO: 715 - protein, 11 aa, Artificial Sequence
  Description of Artificial Sequence: Synthetic light chain variable region CDR L1
RASHSVNYNLA

SEQ ID NO: 716 - DNA, 33 bp, Artificial Sequence
  Description of Artificial Sequence: Synthetic light chain variable region CDR L1
agggccagtcacagtgttaactacaatttagcc

SEQ ID NO: 717 - protein, 7 aa, Artificial Sequence
  Description of Artificial Sequence: Synthetic light chain variable region CDR L2
GSSTRAT

SEQ ID NO: 718 - DNA, 21 bp, Artificial Sequence
  Description of Artificial Sequence: Synthetic light chain variable region CDR L2
ggttcatctaccagggccact

SEQ ID NO: 719 - protein, 11 aa, Artificial Sequence
  Description of Artificial Sequence: Synthetic light chain variable region CDR L3
QQYNNWPPGGT

SEQ ID NO: 720 - DNA, 33 bp, Artificial Sequence
  Description of Artificial Sequence: Synthetic light chain variable region CDR L3
cagcagtataataactggcctccgggaggcact

SEQ ID NO: 721 - DNA, 369 bp, Artificial Sequence
  Description of Artificial Sequence: Synthetic heavy chain variable region
gaggtgcagctgttggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagattggccgaatagcagctcgtcgccgaactggttcgacccctggggccagggaaccctggtcaccgtctcctca

SEQ ID NO: 722 - protein, 123 aa, Artificial Sequence
  Description of Artificial Sequence: Synthetic heavy chain variable region
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDWPNSSSSPNWFDPWGQGTLVTVSS

SEQ ID NO: 723 - protein, 9 aa, Artificial Sequence
  Description of Artificial Sequence: Synthetic heavy chain variable region CDR H1
FTFSSYSMN

SEQ ID NO: 724 - DNA, 27 bp, Artificial Sequence
  Description of Artificial Sequence: Synthetic heavy chain variable region CDR H1
ttcaccttcagtagctatagcatgaac

SEQ ID NO: 725 - protein, 17 aa, Artificial Sequence
  Description of Artificial Sequence: Synthetic heavy chain variable region CDR H2
SISSSSSYIYYADSVKG

SEQ ID NO: 726 - DNA, 51 bp, Artificial Sequence
  Description of Artificial Sequence: Synthetic heavy chain variable region CDR H2
tccattagtagtagtagtagttacatatactacgcagactcagtgaagggc

SEQ ID NO: 727 - protein, 16 aa, Artificial Sequence
  Description of Artificial Sequence: Synthetic heavy chain variable region CDR H3
ARDWPNSSSSPNWFDP

SEQ ID NO: 728 - DNA, 48 bp, Artificial Sequence
  Description of Artificial Sequence: Synthetic heavy chain variable region CDR H3
gcgagagattggccgaatagcagctcgtcgccgaactggttcgacccc

SEQ ID NO: 729 - DNA, 336 bp, Artificial Sequence
  Description of Artificial Sequence: Synthetic light chain variable region
cagtctgtcctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggtttttatgtcttcggaactgggaccaagctcaccgtccta

SEQ ID NO: 730 - protein, 112 aa, Artificial Sequence
  Description of Artificial Sequence: Synthetic light chain variable region
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKLTVL

SEQ ID NO: 731 - protein, 14 aa, Artificial Sequence
  Description of Artificial Sequence: Synthetic light chain variable region CDR L1
TGSSSNIGAGYDVH

SEQ ID NO: 732 - DNA, 42 bp, Artificial Sequence; identical to SEQ ID NO: 572
  Description of Artificial Sequence: Synthetic light chain variable region CDR L1

SEQ ID NO: 733 - protein, 7 aa, Artificial Sequence
  Description of Artificial Sequence: Synthetic light chain variable region CDR L2
GNSNRPS

SEQ ID NO: 734 - DNA, 21 bp, Artificial Sequence
  Description of Artificial Sequence: Synthetic light chain variable region CDR L2
ggtaacagcaatcggccctca

SEQ ID NO: 735 - protein, 12 aa, Artificial Sequence
  Description of Artificial Sequence: Synthetic light chain variable region CDR L3
QSYDSSLSGFYV

SEQ ID NO: 736 - DNA, 36 bp, Artificial Sequence
  Description of Artificial Sequence: Synthetic light chain variable region CDR L3
cagtcctatgacagcagcctgagtggtttttatgtc

SEQ ID NO: 737 - DNA, 363 bp, Artificial Sequence
  Description of Artificial Sequence: Synthetic heavy chain variable region
caggtccagctggtacagtctggggcagaggtgaaaaagcccggggagtctctgaagatctcctgtcagggttctggatacagctttagcagtttctggatcgtctgggtgcgccagatgcccgggaaaggcctggagtggatggggagcatctatcctggtgactctgacaccagatacaccccgtccttccaaggccaggtcaccatctcagccgacaagtccaccagcaccgcctatttgcagtggaacagcctgaagccctcggacaccgccatgtattactgtgcgaggtgtagtctcagctgcgactactacggagtgaacctctggggccaagggaccacggtcaccgtctcctca

SEQ ID NO: 738 - protein, 121 aa, Artificial Sequence
  Description of Artificial Sequence: Synthetic heavy chain variable region
QVQLVQSGAEVKKPGESLKISCQGSGYSFSSFWIVWVRQMPGKGLEWMGSIYPGDSDTRYTPSFQGQVTISADKSTSTAYLQWNSLKPSDTAMYYCARCSLSCDYYGVNLWGQGTTVTVSS

SEQ ID NO: 739 - protein, 9 aa, Artificial Sequence
  Description of Artificial Sequence: Synthetic heavy chain variable region CDR H1
YSFSSFWIV

SEQ ID NO: 740 - DNA, 27 bp, Artificial Sequence
  Description of Artificial Sequence: Synthetic heavy chain variable region CDR H1
tacagctttagcagtttctggatcgtc

SEQ ID NO: 741 - protein, 17 aa, Artificial Sequence
  Description of Artificial Sequence: Synthetic heavy chain variable region CDR H2
SIYPGDSDTRYTPSFQG

SEQ ID NO: 742 - DNA, 51 bp, Artificial Sequence
  Description of Artificial Sequence: Synthetic heavy chain variable region CDR H2
agcatctatcctggtgactctgacaccagatacaccccgtccttccaaggc

SEQ ID NO: 743 - protein, 14 aa, Artificial Sequence
  Description of Artificial Sequence: Synthetic heavy chain variable region CDR H3
ARCSLSCDYYGVNL

SEQ ID NO: 744 - DNA, 42 bp, Artificial Sequence
  Description of Artificial Sequence: Synthetic heavy chain variable region CDR H3
gcgaggtgtagtctcagctgcgactactacggagtgaacctc

SEQ ID NO: 745 - DNA, 336 bp, Artificial Sequence
  Description of Artificial Sequence: Synthetic light chain variable region
cagtctgtggtgacgcagccgccctcagtgtctggggccccaggacagagggtcaccatctcctgctctgggagcagctccaacatcggggcacgttctgatgtacactggtaccagcagcttccaggaaaagcccccaaactcctcatctatggtaacaccaatcggcccttaggggtccctgaccgattctctggctccacgtctggcacctcagcctccctggccatctctgggctccaggctgaggatgagggatattattactgtcagtcctatgacagcagcctgagtggtttttatgtcttcggaactgggaccaagctcaccgtccta

SEQ ID NO: 746 - protein, 112 aa, Artificial Sequence
  Description of Artificial Sequence: Synthetic light chain variable region
QSVVTQPPSVSGAPGQRVTISCSGSSSNIGARSDVHWYQQLPGKAPKLLIYGNTNRPLGVPDRFSGSTSGTSASLAISGLQAEDEGYYYCQSYDSSLSGFYVFGTGTKLTVL

SEQ ID NO: 747 - protein, 14 aa, Artificial Sequence
  Description of Artificial Sequence: Synthetic light chain variable region CDR L1
SGSSSNIGARSDVH

SEQ ID NO: 748 - DNA, 42 bp, Artificial Sequence
  Description of Artificial Sequence: Synthetic light chain variable region CDR L1
tctgggagcagctccaacatcggggcacgttctgatgtacac

SEQ ID NO: 749 - protein, 7 aa, Artificial Sequence
  Description of Artificial Sequence: Synthetic light chain variable region CDR L2
GNTNRPL

SEQ ID NO: 750 - DNA, 21 bp, Artificial Sequence
  Description of Artificial Sequence: Synthetic light chain variable region CDR L2
ggtaacaccaatcggccctta

SEQ ID NO: 751 - protein, 12 aa, Artificial Sequence
  Description of Artificial Sequence: Synthetic light chain variable region CDR L3
QSYDSSLSGFYV

SEQ ID NO: 752 - DNA, 36 bp, Artificial Sequence; identical to SEQ ID NO: 736
  Description of Artificial Sequence: Synthetic light chain variable region CDR L3

SEQ ID NO: 753 - DNA, 363 bp, Artificial Sequence
  Description of Artificial Sequence: Synthetic heavy chain variable region
caggtgcagctggtggaatctgggggaggcgtggtccagcctgggaggtccctgagactctcctgtgcagcctctggattccccttcagtctctatgccatgcactgggtccgccaggctccaggcaaggggctggagtgggtggcatttatatcatatgatggaagtaataaatactatgcagactccgtgaagggccgattcaccatctccagagacagttccaagaacacgctgtatctgcaaatggacagcctgacacctgaagacacggctgtgtattactgtgcgaaacctatagtggggcctacaacgggttactttgactactggggcccgggaaccctggtcaccgtctcctca

SEQ ID NO: 754 - protein, 121 aa, Artificial Sequence
  Description of Artificial Sequence: Synthetic heavy chain variable region
QVQLVESGGGVVQPGRSLRLSCAASGFPFSLYAMHWVRQAPGKGLEWVAFISYDGSNKYYADSVKGRFTISRDSSKNTLYLQMDSLTPEDTAVYYCAKPIVGPTTGYFDYWGPGTLVTVSS

SEQ ID NO: 755 - protein, 9 aa, Artificial Sequence
  Description of Artificial Sequence: Synthetic heavy chain variable region CDR H1
FPFSLYAMH

SEQ ID NO: 756 - DNA, 27 bp, Artificial Sequence
  Description of Artificial Sequence: Synthetic heavy chain variable region CDR H1
ttccccttcagtctctatgccatgcac

SEQ ID NO: 757 - protein, 17 aa, Artificial Sequence
  Description of Artificial Sequence: Synthetic heavy chain variable region CDR H2
FISYDGSNKYYADSVKG

SEQ ID NO: 758 - DNA, 51 bp, Artificial Sequence
  Description of Artificial Sequence: Synthetic heavy chain variable region CDR H2
tttatatcatatgatggaagtaataaatactatgcagactccgtgaagggc

SEQ ID NO: 759 - protein, 14 aa, Artificial Sequence
  Description of Artificial Sequence: Synthetic heavy chain variable region CDR H3
AKPIVGPTTGYFDY

SEQ ID NO: 760 - DNA, 42 bp, Artificial Sequence
  Description of Artificial Sequence: Synthetic heavy chain variable region CDR H3
gcgaaacctatagtggggcctacaacgggttactttgactac

SEQ ID NO: 761 - DNA, 318 bp, Artificial Sequence
  Description of Artificial Sequence: Synthetic light chain variable region
gaaattgtgttgactcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggtacacttttggccaggggaccaaggtggaaatcaaa

SEQ ID NO: 762 - protein, 106 aa, Artificial Sequence
  Description of Artificial Sequence: Synthetic light chain variable region
EIVLTQSPATLSLSPGERATLSCRASQSVSSYLAWYQQKPGQAPRLLIYDASNRATGIPARFSGSGSGTDFTLTISSLEPEDFAVYYCQQRSNWYTFGQGTKVEIK

SEQ ID NO: 763 - protein, 11 aa, Artificial Sequence
  Description of Artificial Sequence: Synthetic light chain variable region CDR L1
RASQSVSSYLA

SEQ ID NO: 764 - DNA, 33 bp, Artificial Sequence
  Description of Artificial Sequence: Synthetic light chain variable region CDR L1
agggccagtcagagtgttagcagctacttagcc

SEQ ID NO: 765 - protein, 7 aa, Artificial Sequence
  Description of Artificial Sequence: Synthetic light chain variable region CDR L2
DASNRAT

SEQ ID NO: 766 - DNA, 21 bp, Artificial Sequence
  Description of Artificial Sequence: Synthetic light chain variable region CDR L2
gatgcatccaacagggccact

SEQ ID NO: 767 - protein, 8 aa, Artificial Sequence
  Description of Artificial Sequence: Synthetic light chain variable region CDR L3
QQRSNWYT

SEQ ID NO: 768 - DNA, 24 bp, Artificial Sequence
  Description of Artificial Sequence: Synthetic light chain variable region CDR L3
cagcagcgtagcaactggtacact

SEQ ID NO: 769 - DNA, 363 bp, Artificial Sequence
  Description of Artificial Sequence: Synthetic heavy chain variable region
gaggtgcagctggtggagtctggggctgaggtgaagaagcctggggcctcagtgaaggtctcctgccagacttctggttacacctttagtcatttcggtgtcacctggatacgacaggccccaggacaagggcttgagtggctgggatggatcagcgcttacaatggtaacacagactatgcagacaaactgcagggcagactcaccatgaccacagacacatccacgaacaccgcctacatggaattgaggagcctcagatctgacgacacggccgtctattactgtgcgagagatccccccgcatcagctgctgcgatgcttgactactggggccagggaaccctggtcaccgtctcctca

SEQ ID NO: 770 - protein, 121 aa, Artificial Sequence
  Description of Artificial Sequence: Synthetic heavy chain variable region
EVQLVESGAEVKKPGASVKVSCQTSGYTFSHFGVTWIRQAPGQGLEWLGWISAYNGNTDYADKLQGRLTMTTDTSTNTAYMELRSLRSDDTAVYYCARDPPASAAAMLDYWGQGTLVTVSS

SEQ ID NO: 771 - protein, 9 aa, Artificial Sequence
  Description of Artificial Sequence: Synthetic heavy chain variable region CDR H1
YTFSHFGVT

SEQ ID NO: 772 - DNA, 27 bp, Artificial Sequence
  Description of Artificial Sequence: Synthetic heavy chain variable region CDR H1
tacacctttagtcatttcggtgtcacc

SEQ ID NO: 773 - protein, 17 aa, Artificial Sequence
  Description of Artificial Sequence: Synthetic heavy chain variable region CDR H2
WISAYNGNTDYADKLQG

SEQ ID NO: 774 - DNA, 51 bp, Artificial Sequence
  Description of Artificial Sequence: Synthetic heavy chain variable region CDR H2
tggatcagcgcttacaatggtaacacagactatgcagacaaactgcagggc

SEQ ID NO: 775 - protein, 14 aa, Artificial Sequence
  Description of Artificial Sequence: Synthetic heavy chain variable region CDR H3
ARDPPASAAAMLDY

SEQ ID NO: 776 - DNA, 42 bp, Artificial Sequence
  Description of Artificial Sequence: Synthetic heavy chain variable region CDR H3
gcgagagatccccccgcatcagctgctgcgatgcttgactac

SEQ ID NO: 777 - DNA, 339 bp, Artificial Sequence
  Description of Artificial Sequence: Synthetic light chain variable region
gatattgtgatgactcagtctccactctccctggccgtcacccttggacagccggcctccatctcctgcaagtctagtcaaggcctcgaatacactgatggaaacacctacttgagttggtttcagcagaggccaggccaatctccaaggcgcctcatttataagatttctaaccgggactctggggttccagacagattcagcggcagtgggtcaggcactgatttcacactgagaatcagcagggtggaggctgaggatgttggggtttattactgcatgcaaggtacacacgggcggggaatctctttcggtcctgggaccaaagtggatatcaaa

SEQ ID NO: 778 - protein, 113 aa, Artificial Sequence
  Description of Artificial Sequence: Synthetic light chain variable region
DIVMTQSPLSLAVTLGQPASISCKSSQGLEYTDGNTYLSWFQQRPGQSPRRLIYKISNRDSGVPDRFSGSGSGTDFTLRISRVEAEDVGVYYCMQGTHGRGISFGPGTKVDIK

SEQ ID NO: 779 - protein, 16 aa, Artificial Sequence
  Description of Artificial Sequence: Synthetic light chain variable region CDR L1
KSSQGLEYTDGNTYLS

SEQ ID NO: 780 - DNA, 48 bp, Artificial Sequence
  Description of Artificial Sequence: Synthetic light chain variable region CDR L1
aagtctagtcaaggcctcgaatacactgatggaaacacctacttgagt

SEQ ID NO: 781 - protein, 7 aa, Artificial Sequence
  Description of Artificial Sequence: Synthetic light chain variable region CDR L2
KISNRDS

SEQ ID NO: 782 - DNA, 21 bp, Artificial Sequence
  Description of Artificial Sequence: Synthetic light chain variable region CDR L2
aagatttctaaccgggactct

SEQ ID NO: 783 - protein, 10 aa, Artificial Sequence
  Description of Artificial Sequence: Synthetic light chain variable region CDR L3
MQGTHGRGIS

SEQ ID NO: 784 - DNA, 30 bp, Artificial Sequence
  Description of Artificial Sequence: Synthetic light chain variable region CDR L3
atgcaaggtacacacgggcggggaatctct

SEQ ID NO: 785 - DNA, 363 bp, Artificial Sequence
  Description of Artificial Sequence: Synthetic heavy chain variable region
caggtgcagctggtgcagtctggggctgaagtgaagaagcctggggcctcagtgaaggtctcctgcaaggcttctggatacaccttcaccgactactttatacactgggtgcgccaggcccctggagaagggcttgagtggatgggttgggtcaaccctctcagtgacaacacaaaatattcacagaagtttcagggcagggtcaccatgagcacggacacgtccatcaccacggcctacatgtacctgagcaggctgcgatttgacgacacggccgtgtatttttgtgcgagccaatcttccccctataccccgggcgctctggacgtctggggccaagggaccacggtcaccgtctcctca

SEQ ID NO: 786 - protein, 121 aa, Artificial Sequence
  Description of Artificial Sequence: Synthetic heavy chain variable region
QVQLVQSGAEVKKPGASVKVSCKASGYTFTDYFIHWVRQAPGEGLEWMGWVNPLSDNTKYSQKFQGRVTMSTDTSITTAYMYLSRLRFDDTAVYFCASQSSPYTPGALDVWGQGTTVTVSS

SEQ ID NO: 787 - protein, 9 aa, Artificial Sequence
  Description of Artificial Sequence: Synthetic heavy chain variable region CDR H1
YTFTDYFIH

SEQ ID NO: 788 - DNA, 27 bp, Artificial Sequence
  Description of Artificial Sequence: Synthetic heavy chain variable region CDR H1
tacaccttcaccgactactttatacac

SEQ ID NO: 789 - protein, 17 aa, Artificial Sequence
  Description of Artificial Sequence: Synthetic heavy chain variable region CDR H2
WVNPLSDNTKYSQKFQG

SEQ ID NO: 790 - DNA, 51 bp, Artificial Sequence
  Description of Artificial Sequence: Synthetic heavy chain variable region CDR H2
tgggtcaaccctctcagtgacaacacaaaatattcacagaagtttcagggc

SEQ ID NO: 791 - protein, 14 aa, Artificial Sequence
  Description of Artificial Sequence: Synthetic heavy chain variable region CDR H3
ASQSSPYTPGALDV

SEQ ID NO: 792 - DNA, 42 bp, Artificial Sequence
  Description of Artificial Sequence: Synthetic heavy chain variable region CDR H3
gcgagccaatcttccccctataccccgggcgctctggacgtc

SEQ ID NO: 793 - DNA, 321 bp, Artificial Sequence
  Description of Artificial Sequence: Synthetic light chain variable region
gacatccagttgacccagtctccatcctccctgcctgcatctgtaggagacagagtcaccatcacttgccgggcaagtcagaacattgggaacaatttagcttggtatcagcagaaagcaggaagagcccccaaactcctgatctatagtgcgtctaatttccatagtggggtcccatcaagattcattggcagtggatctgggacagttttcactctcaccatcagcagtctgcaacctgaagattttgcaacctacttctgtcaacagagtttcactccccaattcactttcggccctgggaccaaggtggaaatcaaa

SEQ ID NO: 794 - protein, 107 aa, Artificial Sequence
  Description of Artificial Sequence: Synthetic light chain variable region
DIQLTQSPSSLPASVGDRVTITCRASQNIGNNLAWYQQKAGRAPKLLIYSASNFHSGVPSRFIGSGSGTVFTLTISSLQPEDFATYFCQQSFTPQFTFGPGTKVEIK

SEQ ID NO: 795 - protein, 11 aa, Artificial Sequence
  Description of Artificial Sequence: Synthetic light chain variable region CDR L1
RASQNIGNNLA

SEQ ID NO: 796 - DNA, 33 bp, Artificial Sequence
  Description of Artificial Sequence: Synthetic light chain variable region CDR L1
cgggcaagtcagaacattgggaacaatttagct

SEQ ID NO: 797 - protein, 7 aa, Artificial Sequence
  Description of Artificial Sequence: Synthetic light chain variable region CDR L2
SASNFHS

SEQ ID NO: 798 - DNA, 21 bp, Artificial Sequence
  Description of Artificial Sequence: Synthetic light chain variable region CDR L2
agtgcgtctaatttccatagt

SEQ ID NO: 799 - protein, 9 aa, Artificial Sequence
  Description of Artificial Sequence: Synthetic light chain variable region CDR L3
QQSFTPQFT

SEQ ID NO: 800 - DNA, 27 bp, Artificial Sequence
  Description of Artificial Sequence: Synthetic light chain variable region CDR L3
caacagagtttcactccccaattcact

SEQ ID NO: 801 - DNA, 384 bp, Artificial Sequence
  Description of Artificial Sequence: Synthetic heavy chain variable region
caggtccagctggtgcagtctggggctgaggtgaagaggcctgggtcctcggtgagggtctcctgcaaggcttctggaggcaccttcaggaagtatgctatcagttgggtgcgacaggcccgtggacaagggcttgagtggatgggaggcatcatccctatgtccggaccaccaagctacgcacagaagtttcagggcagagtcacgattaccgcggacgaatccacgagcacagtctacatggagctgagcagcctgagatttgaggacacggccgtgtatttctgtgcgagggatatcgagtggttcgtactcatggaccctatcacatcctactaccctatggacgtctggggccaagggaccacggtcaccgtctcctca

SEQ ID NO: 802 - protein, 128 aa, Artificial Sequence
  Description of Artificial Sequence: Synthetic heavy chain variable region
QVQLVQSGAEVKRPGSSVRVSCKASGGTFRKYAISWVRQARGQGLEWMGGIIPMSGPPSYAQKFQGRVTITADESTSTVYMELSSLRFEDTAVYFCARDIEWFVLMDPITSYYPMDVWGQGTTVTVSS

SEQ ID NO: 803 - protein, 9 aa, Artificial Sequence
  Description of Artificial Sequence: Synthetic heavy chain variable region CDR H1
GTFRKYAIS

SEQ ID NO: 804 - DNA, 27 bp, Artificial Sequence
  Description of Artificial Sequence: Synthetic heavy chain variable region CDR H1
ggcaccttcaggaagtatgctatcagt

SEQ ID NO: 805 - protein, 17 aa, Artificial Sequence
  Description of Artificial Sequence: Synthetic heavy chain variable region CDR H2
GIIPMSGPPSYAQKFQG

SEQ ID NO: 806 - DNA, 51 bp, Artificial Sequence
  Description of Artificial Sequence: Synthetic heavy chain variable region CDR H2
ggcatcatccctatgtccggaccaccaagctacgcacagaagtttcagggc

SEQ ID NO: 807 - protein, 21 aa, Artificial Sequence
  Description of Artificial Sequence: Synthetic heavy chain variable region CDR H3
ARDIEWFVLMDPITSYYPMDV

SEQ ID NO: 808 - DNA, 63 bp, Artificial Sequence
  Description of Artificial Sequence: Synthetic heavy chain variable region CDR H3
gcgagggatatcgagtggttcgtactcatggaccctatcacatcctactaccctatggacgtc

SEQ ID NO: 809 - DNA, 330 bp, Artificial Sequence
  Description of Artificial Sequence: Synthetic light chain variable region
cagtctgtggtgacccaggagccctcactgactgtgtccccaggagggacagtcactctcacctgtggctccagcactggaggtgtcaccagtggtcatcatacatactggttccagcagaagcctggccaagcccccaggacactgatctatgatacgaccaacacacactcctggacaccagcccggttcgcaggctccctccttgggggcaaagctgccctgaccctttcgggtgcgcagcctgaggatgaggctgactattactgcctcctctcctatagtggtgcgcggccggtgttcggcggagggaccaagctgaccgtccta

SEQ ID NO: 810 - protein, 110 aa, Artificial Sequence
  Description of Artificial Sequence: Synthetic light chain variable region
QSVVTQEPSLTVSPGGTVTLTCGSSTGGVTSGHHTYWFQQKPGQAPRTLIYDTTNTHSWTPARFAGSLLGGKAALTLSGAQPEDEADYYCLLSYSGARPVFGGGTKLTVL

SEQ ID NO: 811 - protein, 14 aa, Artificial Sequence
  Description of Artificial Sequence: Synthetic light chain variable region CDR L1
GSSTGGVTSGHHTY

SEQ ID NO: 812 - DNA, 42 bp, Artificial Sequence
  Description of Artificial Sequence: Synthetic light chain variable region CDR L1
ggctccagcactggaggtgtcaccagtggtcatcatacatac

SEQ ID NO: 813 - protein, 7 aa, Artificial Sequence
  Description of Artificial Sequence: Synthetic light chain variable region CDR L2
DTTNTHS

SEQ ID NO: 814 - DNA, 21 bp, Artificial Sequence
  Description of Artificial Sequence: Synthetic light chain variable region CDR L2
gatacgaccaacacacactcc

SEQ ID NO: 815 - protein, 10 aa, Artificial Sequence
  Description of Artificial Sequence: Synthetic light chain variable region CDR L3
LLSYSGARPV

SEQ ID NO: 816 - DNA, 30 bp, Artificial Sequence
  Description of Artificial Sequence: Synthetic light chain variable region CDR L3
ctcctctcctatagtggtgcgcggccggtg

SEQ ID NO: 817 - DNA, 384 bp, Artificial Sequence
  Description of Artificial Sequence: Synthetic heavy chain variable region
caggtgcagctggtgcagtctgggggaggcttggtcaagcctggagggtccctgagactctcctgtgcagcctctggattcaccttcaatgattactacatgaattggatccgccaggctccagggaaggggctggaatgggtttcatacattagtagtagtggtgagaccaaatactacgcagactctgtgaagggccgattcaccatctccagggacaacgccaagaactcactgtatctggaaatgaacagcctgagagtcgaggacacggccgtctactactgtgcgagagacgcggtcattgtagtaggaccggttgctgttcactaccaatactacgcggacgtctggggcaaagggaccacggtcaccgtctcttca

SEQ ID NO: 818 - protein, 128 aa, Artificial Sequence
  Description of Artificial Sequence: Synthetic heavy chain variable region
QVQLVQSGGGLVKPGGSLRLSCAASGFTFNDYYMNWIRQAPGKGLEWVSYISSSGETKYYADSVKGRFTISRDNAKNSLYLEMNSLRVEDTAVYYCARDAVIVVGPVAVHYQYYADVWGKGTTVTVSS

SEQ ID NO: 819 - protein, 9 aa, Artificial Sequence
  Description of Artificial Sequence: Synthetic heavy chain variable region CDR H1
FTFNDYYMN

SEQ ID NO: 820 - DNA, 27 bp, Artificial Sequence
  Description of Artificial Sequence: Synthetic heavy chain variable region CDR H1
ttcaccttcaatgattactacatgaat

SEQ ID NO: 821 - protein, 17 aa, Artificial Sequence
  Description of Artificial Sequence: Synthetic heavy chain variable region CDR H2
YISSSGETKYYADSVKG

SEQ ID NO: 822 - DNA, 51 bp, Artificial Sequence
  Description of Artificial Sequence: Synthetic heavy chain variable region CDR H2
tacattagtagtagtggtgagaccaaatactacgcagactctgtgaagggc

SEQ ID NO: 823 - protein, 21 aa, Artificial Sequence
  Description of Artificial Sequence: Synthetic heavy chain variable region CDR H3
ARDAVIVVGPVAVHYQYYADV

SEQ ID NO: 824 - DNA, 63 bp, Artificial Sequence
  Description of Artificial Sequence: Synthetic heavy chain variable region CDR H3
gcgagagacgcggtcattgtagtaggaccggttgctgttcactaccaatactacgcggacgtc

SEQ ID NO: 825 - DNA, 330 bp, Artificial Sequence
  Description of Artificial Sequence: Synthetic light chain variable region
cagccagtgctgactcagccaccctcagcgtctgggacccccgggcagagggtcaccatctcttgttctggaagcacctccaacatcggaagtaacactgtacactggtaccagcaactcccaggaacggcccccagactcctcatctatgttattaatcagcggccctcaggggtcccagaccgattctccggctccaagtctggcacctcagcctccctggccatcagtgggctccagtctgaggatgaggctgattattactgtgcagcatgggatgacagcctgaatggtccggtgttcggcggagggaccaagctcaccgtccta

SEQ ID NO: 826 - protein, 110 aa, Artificial Sequence
  Description of Artificial Sequence: Synthetic light chain variable region
QPVLTQPPSASGTPGQRVTISCSGSTSNIGSNTVHWYQQLPGTAPRLLIYVINQRPSGVPDRFSGSKSGTSASLAISGLQSEDEADYYCAAWDDSLNGPVFGGGTKLTVL

SEQ ID NO: 827 - protein, 13 aa, Artificial Sequence
  Description of Artificial Sequence: Synthetic light chain variable region CDR L1
SGSTSNIGSNTVH

SEQ ID NO: 828 - DNA, 39 bp, Artificial Sequence
  Description of Artificial Sequence: Synthetic light chain variable region CDR L1
tctggaagcacctccaacatcggaagtaacactgtacac

SEQ ID NO: 829 - protein, 7 aa, Artificial Sequence
  Description of Artificial Sequence: Synthetic light chain variable region CDR L2
VINQRPS

SEQ ID NO: 830 - DNA, 21 bp, Artificial Sequence
  Description of Artificial Sequence: Synthetic light chain variable region CDR L2
gttattaatcagcggccctca

SEQ ID NO: 831 - protein, 11 aa, Artificial Sequence
  Description of Artificial Sequence: Synthetic light chain variable region CDR L3
AAWDDSLNGPV

SEQ ID NO: 832 - DNA, 33 bp, Artificial Sequence
  Description of Artificial Sequence: Synthetic light chain variable region CDR L3
gcagcatgggatgacagcctgaatggtccggtg

SEQ ID NO: 833 - DNA, 375 bp, Artificial Sequence
  Description of Artificial Sequence: Synthetic heavy chain variable region
caggtccagcttgtgcagtctggggctgaggtgaagaagcctgggtcctcggtgaaggtctcctgcaaggcctctggaggcaccttcagcggctaccatatcagctgggtgcgacaggcccctggacaagggctcgagtggatgggagggatcatccatctatttgggacagttaactacgctccgaagttccagggcagagtcacgatcaccgcggacgcatccacgggcacagcctacatggagttaaacagcctgatgtctgaagacacggccgtttattattgtgcgagagatgcctacgaagtgtggactggttcttatctccccccttttgactactggggccagggaaccctggtcaccgtctcctca

SEQ ID NO: 834 - protein, 125 aa, Artificial Sequence
  Description of Artificial Sequence: Synthetic heavy chain variable region
QVQLVQSGAEVKKPGSSVKVSCKASGGTFSGYHISWVRQAPGQGLEWMGGIIHLFGTVNYAPKFQGRVTITADASTGTAYMELNSLMSEDTAVYYCARDAYEVWTGSYLPPFDYWGQGTLVTVSS

SEQ ID NO: 835 - protein, 9 aa, Artificial Sequence
  Description of Artificial Sequence: Synthetic heavy chain variable region CDR H1
GTFSGYHIS

SEQ ID NO: 836 - DNA, 27 bp, Artificial Sequence
  Description of Artificial Sequence: Synthetic heavy chain variable region CDR H1
ggcaccttcagcggctaccatatcagc

SEQ ID NO: 837 - protein, 17 aa, Artificial Sequence
  Description of Artificial Sequence: Synthetic heavy chain variable region CDR H2
GIIHLFGTVNYAPKFQG

SEQ ID NO: 838 - DNA, 51 bp, Artificial Sequence
  Description of Artificial Sequence: Synthetic heavy chain variable region CDR H2
gggatcatccatctatttgggacagttaactacgctccgaagttccagggc

SEQ ID NO: 839 - protein, 18 aa, Artificial Sequence
  Description of Artificial Sequence: Synthetic heavy chain variable region CDR H3
ARDAYEVWTGSYLPPFDY

SEQ ID NO: 840 - DNA, 54 bp, Artificial Sequence
  Description of Artificial Sequence: Synthetic heavy chain variable region CDR H3
gcgagagatgcctacgaagtgtggactggttcttatctccccccttttgactac

SEQ ID NO: 841 - DNA, 324 bp, Artificial Sequence
  Description of Artificial Sequence: Synthetic light chain variable region
gaaattgtgttgacacagtctccaggcaccctgtctttgtctcccggggaaagagtcaccctctcctgcagggccagtcagactgttacaagcagctacttagcctggtaccagcagaaacctggccaggctcccaggctcctcatctatggtgcattcaccagggccactgacatcccagacaggttcagtggcagtgggtctgggacagacttcactctcaccatcagcagactggagcctgaagattctgcagtatattattgtcagcagtatggtagctcattcctcactttcggcggagggaccaaagtggatatcaaa

SEQ ID NO: 842 - protein, 108 aa, Artificial Sequence
  Description of Artificial Sequence: Synthetic light chain variable region
EIVLTQSPGTLSLSPGERVTLSCRASQTVTSSYLAWYQQKPGQAPRLLIYGAFTRATDIPDRFSGSGSGTDFTLTISRLEPEDSAVYYCQQYGSSFLTFGGGTKVDIK

SEQ ID NO: 843 - protein, 12 aa, Artificial Sequence
  Description of Artificial Sequence: Synthetic light chain variable region CDR L1
RASQTVTSSYLA

SEQ ID NO: 844 - DNA, 36 bp, Artificial Sequence
  Description of Artificial Sequence: Synthetic light chain variable region CDR L1
agggccagtcagactgttacaagcagctacttagcc

SEQ ID NO: 845 - protein, 7 aa, Artificial Sequence
  Description of Artificial Sequence: Synthetic light chain variable region CDR L2
GAFTRAT

SEQ ID NO: 846 - DNA, 21 bp, Artificial Sequence
  Description of Artificial Sequence: Synthetic light chain variable region CDR L2
ggtgcattcaccagggccact

SEQ ID NO: 847 - protein, 9 aa, Artificial Sequence
  Description of Artificial Sequence: Synthetic light chain variable region CDR L3
QQYGSSFLT

SEQ ID NO: 848 - DNA, 27 bp, Artificial Sequence
  Description of Artificial Sequence: Synthetic light chain variable region CDR L3
cagcagtatggtagctcattcctcact

SEQ ID NO: 849 - DNA, 387 bp, Artificial Sequence
  Description of Artificial Sequence: Synthetic heavy chain variable region
gaggtgcagctggtggagtctgggggaggcttgcaaaagcccgggcggtccctgcgactctcatgttcagcttctggattcacctttggtgattatgctatgagctggttccgccaggctccagggaagggcctggagtgggttggtttcattagaagtaaagcttatgttgggaccgcagaatacgccgcgtctgtgaaaggcagattcaccatctcaagagatgattccaaaagcatcgcctatctgcacatgaacagcctgaagaccgaggacacagccgtgtattactgtactagagatgatattttgactggtttttatgaccgctcttactattacggtatacacgtctggggccaagggaccacggtcaccgtctcctca

SEQ ID NO: 850 - protein, 129 aa, Artificial Sequence
  Description of Artificial Sequence: Synthetic heavy chain variable region
EVQLVESGGGLQKPGRSLRLSCSASGFTFGDYAMSWFRQAPGKGLEWVGFIRSKAYVGTAEYAASVKGRFTISRDDSKSIAYLHMNSLKTEDTAVYYCTRDDILTGFYDRSYYYGIHVWGQGTTVTVSS

SEQ ID NO: 851 - protein, 9 aa, Artificial Sequence
  Description of Artificial Sequence: Synthetic heavy chain variable region CDR H1
FTFGDYAMS

SEQ ID NO: 852 - DNA, 27 bp, Artificial Sequence
  Description of Artificial Sequence: Synthetic heavy chain variable region CDR H1
ttcacctttggtgattatgctatgagc

SEQ ID NO: 853 - protein, 19 aa, Artificial Sequence
  Description of Artificial Sequence: Synthetic heavy chain variable region CDR H2
FIRSKAYVGTAEYAASVKG

SEQ ID NO: 854 - DNA, 57 bp, Artificial Sequence
  Description of Artificial Sequence: Synthetic heavy chain variable region CDR H2
ttcattagaagtaaagcttatgttgggaccgcagaatacgccgcgtctgtgaaaggc

SEQ ID NO: 855 - protein, 20 aa, Artificial Sequence
  Description of Artificial Sequence: Synthetic heavy chain variable region CDR H3
TRDDILTGFYDRSYYYGIHV

SEQ ID NO: 856 - DNA, 60 bp, Artificial Sequence
  Description of Artificial Sequence: Synthetic heavy chain variable region CDR H3
actagagatgatattttgactggtttttatgaccgctcttactattacggtatacacgtc

SEQ ID NO: 857 - DNA, 324 bp, Artificial Sequence
  Description of Artificial Sequence: Synthetic light chain variable region
gaaattgtaatgacgcagtctccagtcaccctgtctgtgtctccaggggaaagagccaccctctcctgcagggccagtcagagtgttaacagcaacttagcctggtaccagaagaaacctggccaggctcccaggctcctcatctatagtgcatccaccagggccactggtgtcccagccaggttcagtggcagtgggtctgggacagagttcactctcaccgtcagcagccttcagtctgaagattttgcagtttattactgtcagcagtatgataactggcctccgtacacttttggccaggggaccaaggtggaaatcaaa

SEQ ID NO: 858 - protein, 108 aa, Artificial Sequence
  Description of Artificial Sequence: Synthetic light chain variable region
EIVMTQSPVTLSVSPGERATLSCRASQSVNSNLAWYQKKPGQAPRLLIYSASTRATGVPARFSGSGSGTEFTLTVSSLQSEDFAVYYCQQYDNWPPYTFGQGTKVEIK

SEQ ID NO: 859 - protein, 11 aa, Artificial Sequence
  Description of Artificial Sequence: Synthetic light chain variable region CDR L1
RASQSVNSNLA

SEQ ID NO: 860 - DNA, 33 bp, Artificial Sequence
  Description of Artificial Sequence: Synthetic light chain variable region CDR L1
agggccagtcagagtgttaacagcaacttagcc

SEQ ID NO: 861 - protein, 7 aa, Artificial Sequence
  Description of Artificial Sequence: Synthetic light chain variable region CDR L2
SASTRAT

SEQ ID NO: 862 - DNA, 21 bp, Artificial Sequence
  Description of Artificial Sequence: Synthetic light chain variable region CDR L2
agtgcatccaccagggccact

SEQ ID NO: 863 - protein, 10 aa, Artificial Sequence
  Description of Artificial Sequence: Synthetic light chain variable region CDR L3
QQYDNWPPYT

SEQ ID NO: 864 - DNA, 30 bp, Artificial Sequence
  Description of Artificial Sequence: Synthetic light chain variable region CDR L3
cagcagtatgataactggcctccgtacact

SEQ ID NO: 865 - DNA, 381 bp, Artificial Sequence
  Description of Artificial Sequence: Synthetic heavy chain variable region
caggtgcagctgcaggagtcgggcccaggactggtgaggccttcacagaccctgtccctcacctgctccgcctctggtgcagccatcaatagtggtgattattactggagttggatccgccaggcccctgggaggggcctagagtggattgggtccatttccaaccgtggggtcaccgactacaacccgtccctcaagagtcgagttatcatatcagcggacacgtccaagaatcagttctccctgaggctgacctctgtgactgccacagacacggccgtgtattattgtgccagagatttgggtactttggcctttgatccctactactattacggtattgacgtctggggccaagggaccacggtcaccgtctcctca

SEQ ID NO: 866 - protein, 127 aa, Artificial Sequence
  Description of Artificial Sequence: Synthetic heavy chain variable region
QVQLQESGPGLVRPSQTLSLTCSASGAAINSGDYYWSWIRQAPGRGLEWIGSISNRGVTDYNPSLKSRVIISADTSKNQFSLRLTSVTATDTAVYYCARDLGTLAFDPYYYYGIDVWGQGTTVTVSS

SEQ ID NO: 867 - protein, 11 aa, Artificial Sequence
  Description of Artificial Sequence: Synthetic heavy chain variable region CDR H1
AAINSGDYYWS

SEQ ID NO: 868 - DNA, 33 bp, Artificial Sequence
  Description of Artificial Sequence: Synthetic heavy chain variable region CDR H1
gcagccatcaatagtggtgattattactggagt

SEQ ID NO: 869 - protein, 16 aa, Artificial Sequence
  Description of Artificial Sequence: Synthetic heavy chain variable region CDR H2
SISNRGVTDYNPSLKS

SEQ ID NO: 870 - DNA, 48 bp, Artificial Sequence
  Description of Artificial Sequence: Synthetic heavy chain variable region CDR H2
tccatttccaaccgtggggtcaccgactacaacccgtccctcaagagt

SEQ ID NO: 871 - protein, 19 aa, Artificial Sequence
  Description of Artificial Sequence: Synthetic heavy chain variable region CDR H3
ARDLGTLAFDPYYYYGIDV

SEQ ID NO: 872 - DNA, 57 bp, Artificial Sequence
  Description of Artificial Sequence: Synthetic heavy chain variable region CDR H3
gccagagatttgggtactttggcctttgatccctactactattacggtattgacgtc

SEQ ID NO: 873 - DNA, 318 bp, Artificial Sequence
  Description of Artificial Sequence: Synthetic light chain variable region
gacatccggatgacccagtctccagccaccctgtctttgtctccaggggaaagagccaccctctcctgcagggccagtcagagtgttagcaggcatttagcctggtaccaacaaaaacctggccaggctccccggctcctcatctatgatgcatcatacagggtcactggcgtcccagacaggttcagtggcagtgggtctgggacagacttcactctcaccatcagcagcctggagtctgaagattttgcaatttatttctgtcagcagcgtagcacctggccgacgttcggccaagggaccaaggtggaaatcaaa

SEQ ID NO: 874 - protein, 106 aa, Artificial Sequence
  Description of Artificial Sequence: Synthetic light chain variable region
DIRMTQSPATLSLSPGERATLSCRASQSVSRHLAWYQQKPGQAPRLLIYDASYRVTGVPDRFSGSGSGTDFTLTISSLESEDFAIYFCQQRSTWPTFGQGTKVEIK

SEQ ID NO: 875 - protein, 11 aa, Artificial Sequence
  Description of Artificial Sequence: Synthetic light chain variable region CDR L1
RASQSVSRHLA

SEQ ID NO: 876 - DNA, 33 bp, Artificial Sequence
  Description of Artificial Sequence: Synthetic light chain variable region CDR L1
agggccagtcagagtgttagcaggcatttagcc

SEQ ID NO: 877 - protein, 7 aa, Artificial Sequence
  Description of Artificial Sequence: Synthetic light chain variable region CDR L2
DASYRVT

SEQ ID NO: 878 - DNA, 21 bp, Artificial Sequence
  Description of Artificial Sequence: Synthetic light chain variable region CDR L2
gatgcatcatacagggtcact

SEQ ID NO: 879 - protein, 8 aa, Artificial Sequence
  Description of Artificial Sequence: Synthetic light chain variable region CDR L3
QQRSTWPT

SEQ ID NO: 880 - DNA, 24 bp, Artificial Sequence
  Description of Artificial Sequence: Synthetic light chain variable region CDR L3
cagcagcgtagcacctggccgacg

SEQ ID NO: 881 - DNA, 366 bp, Artificial Sequence
  Description of Artificial Sequence: Synthetic heavy chain variable region
caggtgcagctggtggaatctggggctgaggtgaagaagcctggggcctcagtgaaggttgcctgcacggcgtctggatacgccttcaccaattacaacatccactgggtgcgactggcccctggacagggacttgagtggatggcaattatcaaccccggtagtggtggcacagactactcagagaagttccagggcaggctcaccttgaccagtgacacgtccacgagcacggtgtacatgacgctgggcagcctgagatatgaagacacggccttttattactgtgcgagaaggggttaccctgattcggggagttacccccttgactactggggccagggaaccctggtcaccgtctcctca

SEQ ID NO: 882 - protein, 122 aa, Artificial Sequence
  Description of Artificial Sequence: Synthetic heavy chain variable region
QVQLVESGAEVKKPGASVKVACTASGYAFTNYNIHWVRLAPGQGLEWMAIINPGSGGTDYSEKFQGRLTLTSDTSTSTVYMTLGSLRYEDTAFYYCARRGYPDSGSYPLDYWGQGTLVTVSS

SEQ ID NO: 883 - protein, 9 aa, Artificial Sequence
  Description of Artificial Sequence: Synthetic heavy chain variable region CDR H1
YAFTNYNIH

SEQ ID NO: 884 - DNA, 27 bp, Artificial Sequence
  Description of Artificial Sequence: Synthetic heavy chain variable region CDR H1
tacgccttcaccaattacaacatccac

SEQ ID NO: 885 - protein, 17 aa, Artificial Sequence
  Description of Artificial Sequence: Synthetic heavy chain variable region CDR H2
IINPGSGGTDYSEKFQG

SEQ ID NO: 886 - DNA, 51 bp, Artificial Sequence
  Description of Artificial Sequence: Synthetic heavy chain variable region CDR H2
attatcaaccccggtagtggtggcacagactactcagagaagttccagggc

SEQ ID NO: 887 - protein, 15 aa, Artificial Sequence
  Description of Artificial Sequence: Synthetic heavy chain variable region CDR H3
ARRGYPDSGSYPLDY

SEQ ID NO: 888 - DNA, 45 bp, Artificial Sequence
  Description of Artificial Sequence: Synthetic heavy chain variable region CDR H3
gcgagaaggggttaccctgattcggggagttacccccttgactac

SEQ ID NO: 889 - DNA, 321 bp, Artificial Sequence
  Description of Artificial Sequence: Synthetic light chain variable region
gatattgtgatgacgcagtctccatcctccctgtctgcatctctgggagacagagtcaccatcacttgccgggcaggtcggagcattgccacttacttaaattggtatcagcagaaaccagggaaagcccctaagctcctgatctatggtgcatccagtttgcaaagtggcgtcccatcaaggttcagtggcagtggctctgggacacatttcactctcaccatcagcagtctgcaacctgaggattttgcaacttactactgtcaacagagttacatccgccctatcactttcggcggagggaccaaggtggagatcaaa

SEQ ID NO: 890 - protein, 107 aa, Artificial Sequence
  Description of Artificial Sequence: Synthetic light chain variable region
DIVMTQSPSSLSASLGDRVTITCRAGRSIATYLNWYQQKPGKAPKLLIYGASSLQSGVPSRFSGSGSGTHFTLTISSLQPEDFATYYCQQSYIRPITFGGGTKVEIK

SEQ ID NO: 891 - protein, 11 aa, Artificial Sequence
  Description of Artificial Sequence: Synthetic light chain variable region CDR L1
RAGRSIATYLN

SEQ ID NO: 892 - DNA, 33 bp, Artificial Sequence
  Description of Artificial Sequence: Synthetic light chain variable region CDR L1
cgggcaggtcggagcattgccacttacttaaat

SEQ ID NO: 893 - protein, 7 aa, Artificial Sequence
  Description of Artificial Sequence: Synthetic light chain variable region CDR L2
GASSLQS

SEQ ID NO: 894 - DNA, 21 bp, Artificial Sequence
  Description of Artificial Sequence: Synthetic light chain variable region CDR L2
ggtgcatccagtttgcaaagt

SEQ ID NO: 895 - protein, 9 aa, Artificial Sequence
  Description of Artificial Sequence: Synthetic light chain variable region CDR L3
QQSYIRPIT

SEQ ID NO: 896 - DNA, 27 bp, Artificial Sequence
  Description of Artificial Sequence: Synthetic light chain variable region CDR L3
caacagagttacatccgccctatcact

SEQ ID NO: 897 - DNA, 381 bp, Artificial Sequence
  Description of Artificial Sequence: Synthetic heavy chain variable region
caggtgcagctgcaggagtccggcccaggactggtgaagccttcacagaccctgtccctcacctgcactgtctctggtcgtctcctcagcagtggtgattactactggagttggatccgccagtccccagggaggggcctggagtggattggctacgtctatcacagtgggaccacctcgtacaacccgtccctcaagagtcgaattaccatgacagtggacacgtccaagaaccagttcaacctgaggttgacctctgtaacggccgcagacacggccgtgtattactgtgccagagatctcggatatagcagttcctctcccgccttttattacggtatagacttctggggcccagggaccatggtcaccgtctcttca

SEQ ID NO: 898 - protein, 127 aa, Artificial Sequence
  Description of Artificial Sequence: Synthetic heavy chain variable region
QVQLQESGPGLVKPSQTLSLTCTVSGRLLSSGDYYWSWIRQSPGRGLEWIGYVYHSGTTSYNPSLKSRITMTVDTSKNQFNLRLTSVTAADTAVYYCARDLGYSSSSPAFYYGIDFWGPGTMVTVSS

SEQ ID NO: 899 - protein, 11 aa, Artificial Sequence
  Description of Artificial Sequence: Synthetic heavy chain variable region CDR H1
RLLSSGDYYWS

SEQ ID NO: 900 - DNA, 33 bp, Artificial Sequence
  Description of Artificial Sequence: Synthetic heavy chain variable region CDR H1
cgtctcctcagcagtggtgattactactggagt

SEQ ID NO: 901 - protein, 16 aa, Artificial Sequence
  Description of Artificial Sequence: Synthetic heavy chain variable region CDR H2
YVYHSGTTSYNPSLKS

SEQ ID NO: 902 - DNA, 48 bp, Artificial Sequence
  Description of Artificial Sequence: Synthetic heavy chain variable region CDR H2
tacgtctatcacagtgggaccacctcgtacaacccgtccctcaagagt

SEQ ID NO: 903 - protein, 19 aa, Artificial Sequence
  Description of Artificial Sequence: Synthetic heavy chain variable region CDR H3
ARDLGYSSSSPAFYYGIDF

SEQ ID NO: 904 - DNA, 57 bp, Artificial Sequence
  Description of Artificial Sequence: Synthetic heavy chain variable region CDR H3
gccagagatctcggatatagcagttcctctcccgccttttattacggtatagacttc

SEQ ID NO: 905 - DNA, 321 bp, Artificial Sequence
  Description of Artificial Sequence: Synthetic light chain variable region
gaaattgtattgacacagtctccagccaccctgtctttgtctccagggcaaagagcgaccctctcctgcagggccagtcagagtgttggcaactacttagcctggtaccaacaaaaacctggccaggctcccaggctcctcatctatgatgcatccaacagggtcactggcatcccagccaggttcagtggcagtgggtctgggacagacttcactctcaccatcagcaggctagagtctgaagattttgcagtttattactgtcagcagcgtagcaacggggtcctcactttcggcggagggaccaaagtggatatcaaa

SEQ ID NO: 906 - protein, 107 aa, Artificial Sequence
  Description of Artificial Sequence: Synthetic light chain variable region
EIVLTQSPATLSLSPGQRATLSCRASQSVGNYLAWYQQKPGQAPRLLIYDASNRVTGIPARFSGSGSGTDFTLTISRLESEDFAVYYCQQRSNGVLTFGGGTKVDIK

SEQ ID NO: 907 - protein, 11 aa, Artificial Sequence
  Description of Artificial Sequence: Synthetic light chain variable region CDR L1
RASQSVGNYLA

SEQ ID NO: 908 - DNA, 33 bp, Artificial Sequence
  Description of Artificial Sequence: Synthetic light chain variable region CDR L1
agggccagtcagagtgttggcaactacttagcc

SEQ ID NO: 909 - protein, 7 aa, Artificial Sequence
  Description of Artificial Sequence: Synthetic light chain variable region CDR L2
DASNRVT

SEQ ID NO: 910 - DNA, 21 bp, Artificial Sequence
  Description of Artificial Sequence: Synthetic light chain variable region CDR L2
gatgcatccaacagggtcact

SEQ ID NO: 911 - protein, 9 aa, Artificial Sequence
  Description of Artificial Sequence: Synthetic light chain variable region CDR L3
QQRSNGVLT

SEQ ID NO: 912 - DNA, 27 bp, Artificial Sequence
  Description of Artificial Sequence: Synthetic light chain variable region CDR L3
cagcagcgtagcaacggggtcctcact

SEQ ID NO: 913 - DNA, 363 bp, Artificial Sequence
  Description of Artificial Sequence: Synthetic heavy chain variable region
gaggtgcagctgttggagtctggggctgaggtgaagaagcctggggcctcagtgagggtctcctgcaaggcttctggatacaccttcaccgactactttatgaactgggtgcgacaggcccctggagggggccttgagtggatggggtgggtcaatcctctcagtggagccacaaaatatgcacagaagtttcagggcagggtcaccatgaccacggacacgtccatcaccacagggtacctggacttgaggagcctgagagttgacgacacggccatctatttttgtgcgagccagtcttccccttacaccccgggcgctatgggcgtctggggccaagggaccacggtcaccgtctcttca

SEQ ID NO: 914 - protein, 121 aa, Artificial Sequence
  Description of Artificial Sequence: Synthetic heavy chain variable region
EVQLLESGAEVKKPGASVRVSCKASGYTFTDYFMNWVRQAPGGGLEWMGWVNPLSGATKYAQKFQGRVTMTTDTSITTGYLDLRSLRVDDTAIYFCASQSSPYTPGAMGVWGQGTTVTVSS

SEQ ID NO: 915 - protein, 9 aa, Artificial Sequence
  Description of Artificial Sequence: Synthetic heavy chain variable region CDR H1
YTFTDYFMN

SEQ ID NO: 916 - DNA, 27 bp, Artificial Sequence
  Description of Artificial Sequence: Synthetic heavy chain variable region CDR H1
tacaccttcaccgactactttatgaac

SEQ ID NO: 917 - protein, 17 aa, Artificial Sequence
  Description of Artificial Sequence: Synthetic heavy chain variable region CDR H2
WVNPLSGATKYAQKFQG

SEQ ID NO: 918 - DNA, 51 bp, Artificial Sequence
  Description of Artificial Sequence: Synthetic heavy chain variable region CDR H2
tgggtcaatcctctcagtggagccacaaaatatgcacagaagtttcagggc

SEQ ID NO: 919 - protein, 14 aa, Artificial Sequence
  Description of Artificial Sequence: Synthetic heavy chain variable region CDR H3
ASQSSPYTPGAMGV

SEQ ID NO: 920 - DNA, 42 bp, Artificial Sequence
  Description of Artificial Sequence: Synthetic heavy chain variable region CDR H3
gcgagccagtcttccccttacaccccgggcgctatgggcgtc

SEQ ID NO: 921 - DNA, 321 bp, Artificial Sequence
  Description of Artificial Sequence: Synthetic light chain variable region
gacatccaggtgacccagtctccatcctccctgtctgcctctgtaggagacagagtcaccatcacttgccgggcaagtcagagcattagcggctatttaagttggtatcagcagaaaccagggaaagcccctaacctcctgatctatgctacatccaatttatacagtggggtcccatcaaggttcagtggccgtgattctgggacagatttcactctcaccatcaccagtctgcaacctgaagattttgcaacttacttctgtcaactgaattccggtgccctattcactttcggccctgggaccaaggtggagatcaaa

SEQ ID NO: 922 - protein, 107 aa, Artificial Sequence
  Description of Artificial Sequence: Synthetic light chain variable region
DIQVTQSPSSLSASVGDRVTITCRASQSISGYLSWYQQKPGKAPNLLIYATSNLYSGVPSRFSGRDSGTDFTLTITSLQPEDFATYFCQLNSGALFTFGPGTKVEIK

SEQ ID NO: 923 - protein, 11 aa, Artificial Sequence
  Description of Artificial Sequence: Synthetic light chain variable region CDR L1
RASQSISGYLS

SEQ ID NO: 924 - DNA, 33 bp, Artificial Sequence
  Description of Artificial Sequence: Synthetic light chain variable region CDR L1
cgggcaagtcagagcattagcggctatttaagt

SEQ ID NO: 925 - protein, 7 aa, Artificial Sequence
  Description of Artificial Sequence: Synthetic light chain variable region CDR L2
ATSNLYS

SEQ ID NO: 926 - DNA, 21 bp, Artificial Sequence
  Description of Artificial Sequence: Synthetic light chain variable region CDR L2
gctacatccaatttatacagt

SEQ ID NO: 927 - protein, 9 aa, Artificial Sequence
  Description of Artificial Sequence: Synthetic light chain variable region CDR L3
QLNSGALFT

SEQ ID NO: 928 - DNA, 27 bp, Artificial Sequence
  Description of Artificial Sequence: Synthetic light chain variable region CDR L3
caactgaattccggtgccctattcact

SEQ ID NO: 929 - DNA, 384 bp, Artificial Sequence
  Description of Artificial Sequence: Synthetic heavy chain variable region
caggtgcagctgcaggagtcgggcccaggactggtgaagccttcacagaccctgtccctcacctgcactgtctctggtccctccatcagcgctggagattacaactggaattggatccgccaggccccagggaagggcctggagtgggttggatacatcgattacaggggcctcacccactacaacccgtccctcaagggtcgactttccatattaatggacaggtcggcgaaccagttctccctggagctgaattctgtgactgccgcagacacggccgtctactactgtgccagggacgtgggggtctatagtggctacgatgtctttcactactacggcatggacgtctggggccaggggaccacggtcaccgtctcctca

SEQ ID NO: 930 - protein, 128 aa, Artificial Sequence
  Description of Artificial Sequence: Synthetic heavy chain variable region
QVQLQESGPGLVKPSQTLSLTCTVSGPSISAGDYNWNWIRQAPGKGLEWVGYIDYRGLTHYNPSLKGRLSILMDRSANQFSLELNSVTAADTAVYYCARDVGVYSGYDVFHYYGMDVWGQGTTVTVSS

SEQ ID NO: 931 - protein, 11 aa, Artificial Sequence
  Description of Artificial Sequence: Synthetic heavy chain variable region CDR H1
PSISAGDYNWN

SEQ ID NO: 932 - DNA, 33 bp, Artificial Sequence
  Description of Artificial Sequence: Synthetic heavy chain variable region CDR H1
ccctccatcagcgctggagattacaactggaat

SEQ ID NO: 933 - protein, 16 aa, Artificial Sequence
  Description of Artificial Sequence: Synthetic heavy chain variable region CDR H2
YIDYRGLTHYNPSLKG

SEQ ID NO: 934 - DNA, 48 bp, Artificial Sequence
  Description of Artificial Sequence: Synthetic heavy chain variable region CDR H2
tacatcgattacaggggcctcacccactacaacccgtccctcaagggt

SEQ ID NO: 935 - protein, 20 aa, Artificial Sequence
  Description of Artificial Sequence: Synthetic heavy chain variable region CDR H3
ARDVGVYSGYDVFHYYGMDV

SEQ ID NO: 936 - DNA, 60 bp, Artificial Sequence
  Description of Artificial Sequence: Synthetic heavy chain variable region CDR H3
gccagggacgtgggggtctatagtggctacgatgtctttcactactacggcatggacgtc

SEQ ID NO: 937 - DNA, 327 bp, Artificial Sequence
  Description of Artificial Sequence: Synthetic light chain variable region
gaaacgacactcacgcagtctccagtcaccctgtctttgtctccaggggaaagagccaccctctcctgcagggccagtcagtatgttaggaacaactacttagcctggtaccaacacaaacctggccaggctcccaggctcctcatctatagtgcttccagcagggtcactggcaccccagacaggttcagtggcagtgggtctgggacagacttcactctcaccatcagcagactggagcctgaagactttgcagtgtattactgtcagcagtatggtggctcacctccggtcactttcggccctgggaccaaagtggatatcaaa

SEQ ID NO: 938 - protein, 109 aa, Artificial Sequence
  Description of Artificial Sequence: Synthetic light chain variable region
ETTLTQSPVTLSLSPGERATLSCRASQYVRNNYLAWYQHKPGQAPRLLIYSASSRVTGTPDRFSGSGSGTDFTLTISRLEPEDFAVYYCQQYGGSPPVTFGPGTKVDIK

SEQ ID NO: 939 - protein, 12 aa, Artificial Sequence
  Description of Artificial Sequence: Synthetic light chain variable region CDR L1
RASQYVRNNYLA

SEQ ID NO: 940 - DNA, 36 bp, Artificial Sequence
  Description of Artificial Sequence: Synthetic light chain variable region CDR L1
agggccagtcagtatgttaggaacaactacttagcc

SEQ ID NO: 941 - protein, 7 aa, Artificial Sequence
  Description of Artificial Sequence: Synthetic light chain variable region CDR L2
SASSRVT

SEQ ID NO: 942 - DNA, 21 bp, Artificial Sequence
  Description of Artificial Sequence: Synthetic light chain variable region CDR L2
agtgcttccagcagggtcact

SEQ ID NO: 943 - protein, 10 aa, Artificial Sequence
  Description of Artificial Sequence: Synthetic light chain variable region CDR L3
QQYGGSPPVT

SEQ ID NO: 944 - DNA, 30 bp, Artificial Sequence
  Description of Artificial Sequence: Synthetic light chain variable region CDR L3
cagcagtatggtggctcacctccggtcact

SEQ ID NO: 945 - DNA, 360 bp, Artificial Sequence
  Description of Artificial Sequence: Synthetic heavy chain variable region
gaggtgcagctgttggagtccgggggaggcttagttcagcctggggggtccctgagactatcctgtgcagcctctggattcaccttcagtaattactggatgcactgggtccgccaagctccagggaaggggctggtgtgggtctcacgtattagcggtgatggaagtgacacaacctacgcggactccgtggagggccgattcaccatctccagagacaacgccaggagtacactgtatcttcaactgaatagtctcacaggcgacgacacggctgtgtattattgtgcaagagatttgtggaccacctcgccctactttgacctctggggccagggaaccctggtcaccgtctcctca

SEQ ID NO: 946 - protein, 120 aa, Artificial Sequence
  Description of Artificial Sequence: Synthetic heavy chain variable region
EVQLLESGGGLVQPGGSLRLSCAASGFTFSNYWMHWVRQAPGKGLVWVSRISGDGSDTTYADSVEGRFTISRDNARSTLYLQLNSLTGDDTAVYYCARDLWTTSPYFDLWGQGTLVTVSS

SEQ ID NO: 947 - protein, 9 aa, Artificial Sequence
  Description of Artificial Sequence: Synthetic heavy chain variable region CDR H1
FTFSNYWMH

SEQ ID NO: 948 - DNA, 27 bp, Artificial Sequence
  Description of Artificial Sequence: Synthetic heavy chain variable region CDR H1
ttcaccttcagtaattactggatgcac

SEQ ID NO: 949 - protein, 17 aa, Artificial Sequence
  Description of Artificial Sequence: Synthetic heavy chain variable region CDR H2
RISGDGSDTTYADSVEG

SEQ ID NO: 950 - DNA, 51 bp, Artificial Sequence
  Description of Artificial Sequence: Synthetic heavy chain variable region CDR H2
cgtattagcggtgatggaagtgacacaacctacgcggactccgtggagggc

SEQ ID NO: 951 - protein, 13 aa, Artificial Sequence
  Description of Artificial Sequence: Synthetic heavy chain variable region CDR H3
ARDLWTTSPYFDL

SEQ ID NO: 952 - DNA, 39 bp, Artificial Sequence
  Description of Artificial Sequence: Synthetic heavy chain variable region CDR H3
gcaagagatttgtggaccacctcgccctactttgacctc

SEQ ID NO: 953 - DNA, 315 bp, Artificial Sequence
  Description of Artificial Sequence: Synthetic light chain variable region
gaaattgtattgacacagtctcctggcaccctgtctgcatctattggagacagagtcaccatcacttgccgggccagtcagagtcttaatggctggttggcctggtatcagcagaaaccagggaaagcccctaggctcctcatctataagtcgtctagtttagaaagcggggtcccatcaaggttcagcggcagtgcatctgggacagaattcactctcaccatcagcagcctgcagcctgacgattttgcaacttattactgccaacagtataatagttgggcgttcggccaagggaccaaggtggacgtcaaa

SEQ ID NO: 954 - protein, 105 aa, Artificial Sequence
  Description of Artificial Sequence: Synthetic light chain variable region
EIVLTQSPGTLSASIGDRVTITCRASQSLNGWLAWYQQKPGKAPRLLIYKSSSLESGVPSRFSGSASGTEFTLTISSLQPDDFATYYCQQYNSWAFGQGTKVDVK

SEQ ID NO: 955 - protein, 11 aa, Artificial Sequence
  Description of Artificial Sequence: Synthetic light chain variable region CDR L1
RASQSLNGWLA

SEQ ID NO: 956 - DNA, 33 bp, Artificial Sequence
  Description of Artificial Sequence: Synthetic light chain variable region CDR L1
cgggccagtcagagtcttaatggctggttggcc

SEQ ID NO: 957 - protein, 7 aa, Artificial Sequence
  Description of Artificial Sequence: Synthetic light chain variable region CDR L2
KSSSLES

SEQ ID NO: 958 - DNA, 21 bp, Artificial Sequence
  Description of Artificial Sequence: Synthetic light chain variable region CDR L2
aagtcgtctagtttagaaagc

SEQ ID NO: 959 - protein, 7 aa, Artificial Sequence
  Description of Artificial Sequence: Synthetic light chain variable region CDR L3
QQYNSWA

SEQ ID NO: 960 - DNA, 21 bp, Artificial Sequence
  Description of Artificial Sequence: Synthetic light chain variable region CDR L3
caacagtataatagttgggcg

SEQ ID NO: 961 - DNA, 378 bp, Artificial Sequence
  Description of Artificial Sequence: Synthetic heavy chain variable region
caggtgcagctacagcagtggggcgcaggactgttgaagccttcggagaccctgtccctcacctgcgctgtctatggtgggtccttcagtggttactcctggagctggatccgccagtccccagggaaggggctggagtggattggagaaatcaatcatagaggaagcaccaactacaacccgtccctcaagagtcgagtcaccatatcagtagacacgtcgaagaaccagttctccctgaagctgagctctgtgaccgccgcggacacggctgtgtactactgtgcggggaccaattatggagaggttaatacgagtaaccaatacttcttcggtatggacgtctggggccaagggaccacggtcaccgtctcctca

SEQ ID NO: 962 - protein, 126 aa, Artificial Sequence
  Description of Artificial Sequence: Synthetic heavy chain variable region
QVQLQQWGAGLLKPSETLSLTCAVYGGSFSGYSWSWIRQSPGKGLEWIGEINHRGSTNYNPSLKSRVTISVDTSKNQFSLKLSSVTAADTAVYYCAGTNYGEVNTSNQYFFGMDVWGQGTTVTVSS

SEQ ID NO: 963 - protein, 9 aa, Artificial Sequence
  Description of Artificial Sequence: Synthetic heavy chain variable region CDR H1
GSFSGYSWS

SEQ ID NO: 964 - DNA, 27 bp, Artificial Sequence
  Description of Artificial Sequence: Synthetic heavy chain variable region CDR H1
gggtccttcagtggttactcctggagc

SEQ ID NO: 965 - protein, 16 aa, Artificial Sequence
  Description of Artificial Sequence: Synthetic heavy chain variable region CDR H2
EINHRGSTNYNPSLKS

SEQ ID NO: 966 - DNA, 48 bp, Artificial Sequence; identical to SEQ ID NO: 6
  Description of Artificial Sequence: Synthetic heavy chain variable region CDR H2

SEQ ID NO: 967 - protein, 20 aa, Artificial Sequence
  Description of Artificial Sequence: Synthetic heavy chain variable region CDR H3
AGTNYGEVNTSNQYFFGMDV

SEQ ID NO: 968 - DNA, 60 bp, Artificial Sequence
  Description of Artificial Sequence: Synthetic heavy chain variable region CDR H3
gcggggaccaattatggagaggttaatacgagtaaccaatacttcttcggtatggacgtc

SEQ ID NO: 969 - DNA, 321 bp, Artificial Sequence
  Description of Artificial Sequence: Synthetic light chain variable region
gacatccggttgacccagtctccatcctccctgtctgcatctgtaggagacagagtcaccatcacttgccgggcaagtcagagcattaccacctatttaaattggtatcagcagaaaccagggaaagcccctaaactcctgatctatgctgcatccaatttggaaagtggggtcccatcaagtttcagtggcagtggatttgggacagacttcactctcaccatcagcagtctgcaacctgacgattttgcaacttactactgtcaacagagttacagtgccccgctcaccttcggcggagggaccaaagtggatatcaaa

SEQ ID NO: 970 - protein, 107 aa, Artificial Sequence
  Description of Artificial Sequence: Synthetic light chain variable region
DIRLTQSPSSLSASVGDRVTITCRASQSITTYLNWYQQKPGKAPKLLIYAASNLESGVPSSFSGSGFGTDFTLTISSLQPDDFATYYCQQSYSAPLTFGGGTKVDIK

SEQ ID NO: 971 - protein, 11 aa, Artificial Sequence
  Description of Artificial Sequence: Synthetic light chain variable region CDR L1
RASQSITTYLN

SEQ ID NO: 972 - DNA, 33 bp, Artificial Sequence
  Description of Artificial Sequence: Synthetic light chain variable region CDR L1
cgggcaagtcagagcattaccacctatttaaat

SEQ ID NO: 973 - protein, 7 aa, Artificial Sequence
  Description of Artificial Sequence: Synthetic light chain variable region CDR L2
AASNLES

SEQ ID NO: 974 - DNA, 21 bp, Artificial Sequence
  Description of Artificial Sequence: Synthetic light chain variable region CDR L2
gctgcatccaatttggaaagt

SEQ ID NO: 975 - protein, 9 aa, Artificial Sequence
  Description of Artificial Sequence: Synthetic light chain variable region CDR L3
QQSYSAPLT

SEQ ID NO: 976 - DNA, 27 bp, Artificial Sequence
  Description of Artificial Sequence: Synthetic light chain variable region CDR L3
caacagagttacagtgccccgctcacc

SEQ ID NO: 977 - DNA, 363 bp, Artificial Sequence
  Description of Artificial Sequence: Synthetic heavy chain variable region
caggtccagctggtacagtctggggctggggtgaagaagcctggggcctcagtgagggtctcatgcacggcctctggatacaccttcaccgactactttataaactgggtgcgacaggcccctggagggggccttgagtggatggggtgggtcaatcctctcagtggagccacaagatacgcccagaactttgcgggcagggtcaccatgaccacggacacgtccatcaccacaggatatctggacttacggaacctgcgacttgacgacacggccgtctatttttgtgcgagccagtcttcaccttacacgccgggcgctatggacgtctggggccaagggaccacggtcaccgtctcctca

SEQ ID NO: 978 - protein, 121 aa, Artificial Sequence
  Description of Artificial Sequence: Synthetic heavy chain variable region
QVQLVQSGAGVKKPGASVRVSCTASGYTFTDYFINWVRQAPGGGLEWMGWVNPLSGATRYAQNFAGRVTMTTDTSITTGYLDLRNLRLDDTAVYFCASQSSPYTPGAMDVWGQGTTVTVSS

SEQ ID NO: 979 - protein, 9 aa, Artificial Sequence
  Description of Artificial Sequence: Synthetic heavy chain variable region CDR H1
YTFTDYFIN

SEQ ID NO: 980 - DNA, 27 bp, Artificial Sequence
  Description of Artificial Sequence: Synthetic heavy chain variable region CDR H1
tacaccttcaccgactactttataaac

SEQ ID NO: 981 - protein, 17 aa, Artificial Sequence
  Description of Artificial Sequence: Synthetic heavy chain variable region CDR H2
WVNPLSGATRYAQNFAG

SEQ ID NO: 982 - DNA, 51 bp, Artificial Sequence
  Description of Artificial Sequence: Synthetic heavy chain variable region CDR H2
tgggtcaatcctctcagtggagccacaagatacgcccagaactttgcgggc

SEQ ID NO: 983 - protein, 14 aa, Artificial Sequence
  Description of Artificial Sequence: Synthetic heavy chain variable region CDR H3
ASQSSPYTPGAMDV

SEQ ID NO: 984 - DNA, 42 bp, Artificial Sequence
  Description of Artificial Sequence: Synthetic heavy chain variable region CDR H3
gcgagccagtcttcaccttacacgccgggcgctatggacgtc

SEQ ID NO: 985 - DNA, 321 bp, Artificial Sequence
  Description of Artificial Sequence: Synthetic light chain variable region
gatattgtgatgacccagtctccatcctccctgtctgcatctgtaggagacagagtctccatcacttgccggacaagtcagaccattagtggctatataagttggtatcagaagaaaccaggaaaagcccctaaactcctgatctatgctgcatcaaatatgtacagtggggtcccatcaaggttcagtggcagtgaatctgggacagatttcactctcaccatcaccagtctgcaacctgaagattttgcaacttacttctgtcaactgaattccggtgccctattcactttcggccctgggaccaaagtggatatcaaa

SEQ ID NO: 986 - protein, 107 aa, Artificial Sequence
  Description of Artificial Sequence: Synthetic light chain variable region
DIVMTQSPSSLSASVGDRVSITCRTSQTISGYISWYQKKPGKAPKLLIYAASNMYSGVPSRFSGSESGTDFTLTITSLQPEDFATYFCQLNSGALFTFGPGTKVDIK

SEQ ID NO: 987 - protein, 11 aa, Artificial Sequence
  Description of Artificial Sequence: Synthetic light chain variable region CDR L1
RTSQTISGYIS

SEQ ID NO: 988 - DNA, 33 bp, Artificial Sequence
  Description of Artificial Sequence: Synthetic light chain variable region CDR L1
cggacaagtcagaccattagtggctatataagt

SEQ ID NO: 989 - protein, 7 aa, Artificial Sequence
  Description of Artificial Sequence: Synthetic light chain variable region CDR L2
AASNMYS

SEQ ID NO: 990 - DNA, 21 bp, Artificial Sequence
  Description of Artificial Sequence: Synthetic light chain variable region CDR L2
gctgcatcaaatatgtacagt

SEQ ID NO: 991 - protein, 9 aa, Artificial Sequence
  Description of Artificial Sequence: Synthetic light chain variable region CDR L3
QLNSGALFT

SEQ ID NO: 992 - DNA, 27 bp, Artificial Sequence
  Description of Artificial Sequence: Synthetic light chain variable region CDR L3
caactgaattccggtgccctattcact

SEQ ID NO: 993 - DNA, 357 bp, Artificial Sequence
  Description of Artificial Sequence: Synthetic heavy chain variable region
gaggtgcagctggtggagtctgcagcagaggtgaaaaagcccggggagtctctgaagatctcctgtaagggttctggatacagttttgccagccactggatcggttgggtccgccaaatgcccgggaaaggcctggagttgatgggattcatctatcctggtgactctgataccagatacaacccgtccttccaaggccaggtcaccatctcagccgacaagtccatcagcaccgcctacctgcagtggaccaggctgaaggcctcggacaccgccatgtactactgtggccaggcagtggcggggggtgaatatttccaccactggggccagggcaccctggtcaccgtctcctca

SEQ ID NO: 994 - protein, 119 aa, Artificial Sequence
  Description of Artificial Sequence: Synthetic heavy chain variable region
EVQLVESAAEVKKPGESLKISCKGSGYSFASHWIGWVRQMPGKGLELMGFIYPGDSDTRYNPSFQGQVTISADKSISTAYLQWTRLKASDTAMYYCGQAVAGGEYFHHWGQGTLVTVSS

SEQ ID NO: 995 - protein, 9 aa, Artificial Sequence
  Description of Artificial Sequence: Synthetic heavy chain variable region CDR H1
YSFASHWIG

SEQ ID NO: 996 - DNA, 27 bp, Artificial Sequence
  Description of Artificial Sequence: Synthetic heavy chain variable region CDR H1
tacagttttgccagccactggatcggt

SEQ ID NO: 997 - protein, 17 aa, Artificial Sequence
  Description of Artificial Sequence: Synthetic heavy chain variable region CDR H2
FIYPGDSDTRYNPSFQG

SEQ ID NO: 998 - DNA, 51 bp, Artificial Sequence
  Description of Artificial Sequence: Synthetic heavy chain variable region CDR H2
ttcatctatcctggtgactctgataccagatacaacccgtccttccaaggc

SEQ ID NO: 999 - protein, 12 aa, Artificial Sequence
  Description of Artificial Sequence: Synthetic heavy chain variable region CDR H3
GQAVAGGEYFHH

SEQ ID NO: 1000 - DNA, 36 bp, Artificial Sequence
  Description of Artificial Sequence: Synthetic heavy chain variable region CDR H3
ggccaggcagtggcggggggtgaatatttccaccac

SEQ ID NO: 1001 - DNA, 321 bp, Artificial Sequence
  Description of Artificial Sequence: Synthetic light chain variable region
gatattgtgatgacgcagtctccagccaccctgtctgtgtctccaggggaaagagccaccctctcctgcagggccagtcagagtcttggcagcgacttagcctggtaccagcagaaacctggccagactcccaggctcctcatctatgatgcatccaccagggccactggtatcccagccaggttcagtggcagtgggtctgggacagagttcactctcaccatcagcagcctgcagtctgaagattttgcagtttattactgtcagcactataataattggccccgggggttcggccaagggaccaaggtggaaatcaaa

SEQ ID NO: 1002 - protein, 107 aa, Artificial Sequence
  Description of Artificial Sequence: Synthetic light chain variable region
DIVMTQSPATLSVSPGERATLSCRASQSLGSDLAWYQQKPGQTPRLLIYDASTRATGIPARFSGSGSGTEFTLTISSLQSEDFAVYYCQHYNNWPRGFGQGTKVEIK

SEQ ID NO: 1003 - protein, 11 aa, Artificial Sequence
  Description of Artificial Sequence: Synthetic light chain variable region CDR L1
RASQSLGSDLA

SEQ ID NO: 1004 - DNA, 33 bp, Artificial Sequence
  Description of Artificial Sequence: Synthetic light chain variable region CDR L1
agggccagtcagagtcttggcagcgacttagcc

SEQ ID NO: 1005 - protein, 7 aa, Artificial Sequence
  Description of Artificial Sequence: Synthetic light chain variable region CDR L2
DASTRAT

SEQ ID NO: 1006 - DNA, 21 bp, Artificial Sequence
  Description of Artificial Sequence: Synthetic light chain variable region CDR L2
gatgcatccaccagggccact

SEQ ID NO: 1007 - protein, 9 aa, Artificial Sequence
  Description of Artificial Sequence: Synthetic light chain variable region CDR L3
QHYNNWPRG

SEQ ID NO: 1008 - DNA, 27 bp, Artificial Sequence
  Description of Artificial Sequence: Synthetic light chain variable region CDR L3
cagcactataataattggccccggggg

SEQ ID NO: 1009 - DNA, 372 bp, Artificial Sequence
  Description of Artificial Sequence: Synthetic heavy chain variable region
caggtgcagctgcaggagtcgggcccaggacgggtgaagccttcacagaccctgtccctcacctgcactgtctctggtgtctccgtcaccattaatgattactactggacttggctccgccagtccccagggaaaggcctggagtggattggaaacatctataacagtgggagcacctaccagaacccgtccctccagagtcgagttaccatgtcagtggacacggccaagaaccacttctccctgaagctgacctctgtcactgccgcagatacggccgtctattactgtgccagagatttaggcactgccaacaactactacttcggtatggacgtctggggcctagggaccacggtcaccgtctcctca

SEQ ID NO: 1010 - protein, 124 aa, Artificial Sequence
  Description of Artificial Sequence: Synthetic heavy chain variable region
QVQLQESGPGRVKPSQTLSLTCTVSGVSVTINDYYWTWLRQSPGKGLEWIGNIYNSGSTYQNPSLQSRVTMSVDTAKNHFSLKLTSVTAADTAVYYCARDLGTANNYYFGMDVWGLGTTVTVSS

SEQ ID NO: 1011 - protein, 11 aa, Artificial Sequence
  Description of Artificial Sequence: Synthetic heavy chain variable region CDR H1
VSVTINDYYWT

SEQ ID NO: 1012 - DNA, 33 bp, Artificial Sequence
  Description of Artificial Sequence: Synthetic heavy chain variable region CDR H1
gtctccgtcaccattaatgattactactggact

SEQ ID NO: 1013 - protein, 16 aa, Artificial Sequence
  Description of Artificial Sequence: Synthetic heavy chain variable region CDR H2
NIYNSGSTYQNPSLQS

SEQ ID NO: 1014 - DNA, 48 bp, Artificial Sequence
  Description of Artificial Sequence: Synthetic heavy chain variable region CDR H2
aacatctataacagtgggagcacctaccagaacccgtccctccagagt

SEQ ID NO: 1015 - protein, 16 aa, Artificial Sequence
  Description of Artificial Sequence: Synthetic heavy chain variable region CDR H3
ARDLGTANNYYFGMDV

SEQ ID NO: 1016 - DNA, 48 bp, Artificial Sequence
  Description of Artificial Sequence: Synthetic heavy chain variable region CDR H3
gccagagatttaggcactgccaacaactactacttcggtatggacgtc

SEQ ID NO: 1017 - DNA, 324 bp, Artificial Sequence
  Description of Artificial Sequence: Synthetic light chain variable region
gaaattgtgatgacgcagtctccagccaccctgtctttgtctccaggggaaagagccactctctcctgcagggccagtcagagtgttagcacctacttagcctggtaccaacagaaacctggccaggctcccaggctcctcatctataatggatccaacagggtcactggcaccccagccaggttcagtggcagtgggtctgggacagacttcactctcaccatcagcagcgtagagcctgaagattttgcagtttattactgtcagcagcgtagcaactggcctccgtacacttttggccaggggaccaaggtggagatcaaa

SEQ ID NO: 1018 - protein, 108 aa, Artificial Sequence
  Description of Artificial Sequence: Synthetic light chain variable region
EIVMTQSPATLSLSPGERATLSCRASQSVSTYLAWYQQKPGQAPRLLIYNGSNRVTGTPARFSGSGSGTDFTLTISSVEPEDFAVYYCQQRSNWPPYTFGQGTKVEIK

SEQ ID NO: 1019 - protein, 11 aa, Artificial Sequence
  Description of Artificial Sequence: Synthetic light chain variable region CDR L1
RASQSVSTYLA

SEQ ID NO: 1020 - DNA, 33 bp, Artificial Sequence
  Description of Artificial Sequence: Synthetic light chain variable region CDR L1
agggccagtcagagtgttagcacctacttagcc

SEQ ID NO: 1021 - protein, 7 aa, Artificial Sequence
  Description of Artificial Sequence: Synthetic light chain variable region CDR L2
NGSNRVT

SEQ ID NO: 1022 - DNA, 21 bp, Artificial Sequence
  Description of Artificial Sequence: Synthetic light chain variable region CDR L2
aatggatccaacagggtcact

SEQ ID NO: 1023 - protein, 10 aa, Artificial Sequence
  Description of Artificial Sequence: Synthetic light chain variable region CDR L3
QQRSNWPPYT

SEQ ID NO: 1024 - DNA, 30 bp, Artificial Sequence
  Description of Artificial Sequence: Synthetic light chain variable region CDR L3
cagcagcgtagcaactggcctccgtacact

SEQ ID NO: 1025 - DNA, 381 bp, Artificial Sequence
  Description of Artificial Sequence: Synthetic heavy chain variable region
caggtgcagctgcaggagtcgggcccaggactggtgaagccttcggagaccctgtccctcacctgctcggtctctggtgcctccgtcaccagtagggaatactactggggctggatccgccaggcccccgggaagggtctgcagtggattgccagcattcatcacagtccttttcaaagtgacggcaacccgtccctgacgagtcgcgtctccagttccgtagtcacgtccaagaaccagttggccctgaggctgagctctgtgaccgccgcagacacggctgtatattactgtgcgggcgcgttttgggaggtttggactggcctttattcaccgccgtttgacttttggggccagggaatcctggtcaccgtctcctca

SEQ ID NO: 1026 - protein, 127 aa, Artificial Sequence
  Description of Artificial Sequence: Synthetic heavy chain variable region
QVQLQESGPGLVKPSETLSLTCSVSGASVTSREYYWGWIRQAPGKGLQWIASIHHSPFQSDGNPSLTSRVSSSVVTSKNQLALRLSSVTAADTAVYYCAGAFWEVWTGLYSPPFDFWGQGILVTVSS

SEQ ID NO: 1027 - protein, 11 aa, Artificial Sequence
  Description of Artificial Sequence: Synthetic heavy chain variable region CDR H1
ASVTSREYYWG

SEQ ID NO: 1028 - DNA, 33 bp, Artificial Sequence
  Description of Artificial Sequence: Synthetic heavy chain variable region CDR H1
gcctccgtcaccagtagggaatactactggggc

SEQ ID NO: 1029 - protein, 17 aa, Artificial Sequence
  Description of Artificial Sequence: Synthetic heavy chain variable region CDR H2
SIHHSPFQSDGNPSLTS

SEQ ID NO: 1030 - DNA, 51 bp, Artificial Sequence
  Description of Artificial Sequence: Synthetic heavy chain variable region CDR H2
agcattcatcacagtccttttcaaagtgacggcaacccgtccctgacgagt

SEQ ID NO: 1031 - protein, 18 aa, Artificial Sequence
  Description of Artificial Sequence: Synthetic heavy chain variable region CDR H3
AGAFWEVWTGLYSPPFDF

SEQ ID NO: 1032 - DNA, 54 bp, Artificial Sequence
  Description of Artificial Sequence: Synthetic heavy chain variable region CDR H3
gcgggcgcgttttgggaggtttggactggcctttattcaccgccgtttgacttt

SEQ ID NO: 1033 - DNA, 324 bp, Artificial Sequence
  Description of Artificial Sequence: Synthetic light chain variable region
gaaattgtaatgacacagtctccagggaccctgtctttgtctccaggggaaagagccaccctctcctgctgggccagtcagactgttagcagcggctacttagcctggtaccagcagaaacctggccaggctcccaggctcctcatctatggtgcatctaccagggccactgacatcccagacaggttcagtggcagtgggtctgggacaggcttcactctcaccatcagcagactggagcctgaagatcttgcagtctattactgtcagcagtatagcagttcaccactcactttcggcggcgggaccaaggtggaaatcaaa

SEQ ID NO: 1034 - protein, 108 aa, Artificial Sequence
  Description of Artificial Sequence: Synthetic light chain variable region
EIVMTQSPGTLSLSPGERATLSCWASQTVSSGYLAWYQQKPGQAPRLLIYGASTRATDIPDRFSGSGSGTGFTLTISRLEPEDLAVYYCQQYSSSPLTFGGGTKVEIK

SEQ ID NO: 1035 - protein, 12 aa, Artificial Sequence
  Description of Artificial Sequence: Synthetic light chain variable region CDR L1
WASQTVSSGYLA

SEQ ID NO: 1036 - DNA, 36 bp, Artificial Sequence
  Description of Artificial Sequence: Synthetic light chain variable region CDR L1
tgggccagtcagactgttagcagcggctacttagcc

SEQ ID NO: 1037 - protein, 7 aa, Artificial Sequence
  Description of Artificial Sequence: Synthetic light chain variable region CDR L2
GASTRAT

SEQ ID NO: 1038 - DNA, 21 bp, Artificial Sequence
  Description of Artificial Sequence: Synthetic light chain variable region CDR L2
ggtgcatctaccagggccact

SEQ ID NO: 1039 - protein, 9 aa, Artificial Sequence
  Description of Artificial Sequence: Synthetic light chain variable region CDR L3
QQYSSSPLT

SEQ ID NO: 1040 - DNA, 27 bp, Artificial Sequence
  Description of Artificial Sequence: Synthetic light chain variable region CDR L3
cagcagtatagcagttcaccactcact

SEQ ID NO: 1041 - DNA, 363 bp, Artificial Sequence
  Description of Artificial Sequence: Synthetic heavy chain variable region
caggtgcagctggtgcagtctggagctgaggtgaagaagcctggggcctcagtgaaggtctcgtgcaagacttctggttacaccttttccaactacggtatcagctggctgcgacaggcccctggacaagggcttgagtggatggcatggatcagcccttataatgggaacacaaagtctgcacagaggtttcagggcagagtcatcatgaccacagacacatccacgaggacagcccacatggaggtgaagagcctgagaactgacgacacggccacatattactgtgcgagagatccagcagtcgatgcaataccgatgcttgactactggggccagggaaccacggtcaccgtctcctca

SEQ ID NO: 1042 - protein, 121 aa, Artificial Sequence
  Description of Artificial Sequence: Synthetic heavy chain variable region
QVQLVQSGAEVKKPGASVKVSCKTSGYTFSNYGISWLRQAPGQGLEWMAWISPYNGNTKSAQRFQGRVIMTTDTSTRTAHMEVKSLRTDDTATYYCARDPAVDAIPMLDYWGQGTTVTVSS

SEQ ID NO: 1043 - protein, 9 aa, Artificial Sequence
  Description of Artificial Sequence: Synthetic heavy chain variable region CDR H1
YTFSNYGIS

SEQ ID NO: 1044 - DNA, 27 bp, Artificial Sequence
  Description of Artificial Sequence: Synthetic heavy chain variable region CDR H1
tacaccttttccaactacggtatcagc

SEQ ID NO: 1045 - protein, 17 aa, Artificial Sequence
  Description of Artificial Sequence: Synthetic heavy chain variable region CDR H2
WISPYNGNTKSAQRFQG

SEQ ID NO: 1046 - DNA, 51 bp, Artificial Sequence
  Description of Artificial Sequence: Synthetic heavy chain variable region CDR H2
tggatcagcccttataatgggaacacaaagtctgcacagaggtttcagggc

SEQ ID NO: 1047 - protein, 14 aa, Artificial Sequence
  Description of Artificial Sequence: Synthetic heavy chain variable region CDR H3
ARDPAVDAIPMLDY

SEQ ID NO: 1048 - DNA, 42 bp, Artificial Sequence
  Description of Artificial Sequence: Synthetic heavy chain variable region CDR H3
gcgagagatccagcagtcgatgcaataccgatgcttgactac

SEQ ID NO: 1049 - DNA, 336 bp, Artificial Sequence
  Description of Artificial Sequence: Synthetic light chain variable region
gacatccaggtgacccagtctccactctccctgcccgtcacccttggacagccggcctccatctcctgcaggtctagtcaaagcctcgtgtacactgatggaaacacctacttgagctggtttcagcagaggccaggccaatctccaaggcgcctaatttatagggtttctcaccgggactctggggtcccagacagattcaccggcagtgggtcaggcactgatttcacactgataatccgcagggtggaggctgaggatgttggggtttattactgcatgcaaggtacacactggcctctcactttcggcggagggaccaaggtggaaatcaaa

SEQ ID NO: 1050 - protein, 112 aa, Artificial Sequence
  Description of Artificial Sequence: Synthetic light chain variable region
DIQVTQSPLSLPVTLGQPASISCRSSQSLVYTDGNTYLSWFQQRPGQSPRRLIYRVSHRDSGVPDRFTGSGSGTDFTLIIRRVEAEDVGVYYCMQGTHWPLTFGGGTKVEIK

SEQ ID NO: 1051 - protein, 16 aa, Artificial Sequence
  Description of Artificial Sequence: Synthetic light chain variable region CDR L1
RSSQSLVYTDGNTYLS

SEQ ID NO: 1052 - DNA, 48 bp, Artificial Sequence
  Description of Artificial Sequence: Synthetic light chain variable region CDR L1
aggtctagtcaaagcctcgtgtacactgatggaaacacctacttgagc

SEQ ID NO: 1053 - protein, 7 aa, Artificial Sequence
  Description of Artificial Sequence: Synthetic light chain variable region CDR L2
RVSHRDS

SEQ ID NO: 1054 - DNA, 21 bp, Artificial Sequence
  Description of Artificial Sequence: Synthetic light chain variable region CDR L2
agggtttctcaccgggactct

SEQ ID NO: 1055 - protein, 9 aa, Artificial Sequence
  Description of Artificial Sequence: Synthetic light chain variable region CDR L3
MQGTHWPLT

SEQ ID NO: 1056 - DNA, 27 bp, Artificial Sequence
  Description of Artificial Sequence: Synthetic light chain variable region CDR L3
atgcaaggtacacactggcctctcact

SEQ ID NO: 1057 - DNA, 351 bp, Artificial Sequence
  Description of Artificial Sequence: Synthetic heavy chain variable region
caggtccagctggtgcagtctgggggaggcgtggtccagcctgggaggtccctgagactctcctgtgcagcctctggattcacgttcagtgactatgccatgcactgggtccgccaggctccaggcaaggggctggagtgggtggcaatcatatcatatgatgcaaataataaatattatgcagactccgtgaagggccgattcaccatctccagagacaattccaagaacacggtgtatctgcaaatgaacagcctgagacctgaggacacggctgtatattactgtgcgaaagaagagtggctggtgccagcctactggggccagggaatcctggtcaccgtctcctca

SEQ ID NO: 1058 - protein, 117 aa, Artificial Sequence
  Description of Artificial Sequence: Synthetic heavy chain variable region
QVQLVQSGGGVVQPGRSLRLSCAASGFTFSDYAMHWVRQAPGKGLEWVAIISYDANNKYYADSVKGRFTISRDNSKNTVYLQMNSLRPEDTAVYYCAKEEWLVPAYWGQGILVTVSS

SEQ ID NO: 1059 - protein, 9 aa, Artificial Sequence
  Description of Artificial Sequence: Synthetic heavy chain variable region CDR H1
FTFSDYAMH

SEQ ID NO: 1060 - DNA, 27 bp, Artificial Sequence
  Description of Artificial Sequence: Synthetic heavy chain variable region CDR H1
ttcacgttcagtgactatgccatgcac

SEQ ID NO: 1061 - protein, 17 aa, Artificial Sequence
  Description of Artificial Sequence: Synthetic heavy chain variable region CDR H2
IISYDANNKYYADSVKG

SEQ ID NO: 1062 - DNA, 51 bp, Artificial Sequence
  Description of Artificial Sequence: Synthetic heavy chain variable region CDR H2
atcatatcatatgatgcaaataataaatattatgcagactccgtgaagggc

SEQ ID NO: 1063 - protein, 10 aa, Artificial Sequence
  Description of Artificial Sequence: Synthetic heavy chain variable region CDR H3
AKEEWLVPAY

SEQ ID NO: 1064 - DNA, 30 bp, Artificial Sequence
  Description of Artificial Sequence: Synthetic heavy chain variable region CDR H3
gcgaaagaagagtggctggtgccagcctac

SEQ ID NO: 1065 - DNA, 327 bp, Artificial Sequence
  Description of Artificial Sequence: Synthetic light chain variable region
cagtctgtgctgactcagcctgcctccgtgtctgggtctcctggacagtcgatcaccatctcctgcactggaaccagcagtgacgttggtggatataattacgtctcctggtaccaacaacacccaggcaaagcccccaaactcttaatttatgaggtctctaatcggccctcaggggtttctaatcgcttctctggctccaagtctggcaacacggcctccctgaccatctctgggctccagcctgaggacgaggctgattattactgcagctcatattcaaccaatagtgccccctttggaactgggaccaagctcaccgtccta

SEQ ID NO: 1066 - protein, 109 aa, Artificial Sequence
  Description of Artificial Sequence: Synthetic light chain variable region
QSVLTQPASVSGSPGQSITISCTGTSSDVGGYNYVSWYQQHPGKAPKLLIYEVSNRPSGVSNRFSGSKSGNTASLTISGLQPEDEADYYCSSYSTNSAPFGTGTKLTVL

SEQ ID NO: 1067 - protein, 14 aa, Artificial Sequence
  Description of Artificial Sequence: Synthetic light chain variable region CDR L1
TGTSSDVGGYNYVS

SEQ ID NO: 1068 - DNA, 42 bp, Artificial Sequence
  Description of Artificial Sequence: Synthetic light chain variable region CDR L1
actggaaccagcagtgacgttggtggatataattacgtctcc

SEQ ID NO: 1069 - protein, 7 aa, Artificial Sequence
  Description of Artificial Sequence: Synthetic light chain variable region CDR L2
EVSNRPS

SEQ ID NO: 1070 - DNA, 21 bp, Artificial Sequence
  Description of Artificial Sequence: Synthetic light chain variable region CDR L2
gaggtctctaatcggccctca

SEQ ID NO: 1071 - protein, 9 aa, Artificial Sequence
  Description of Artificial Sequence: Synthetic light chain variable region CDR L3
SSYSTNSAP

SEQ ID NO: 1072 - DNA, 27 bp, Artificial Sequence
  Description of Artificial Sequence: Synthetic light chain variable region CDR L3
agctcatattcaaccaatagtgccccc

SEQ ID NO: 1073 - DNA, 366 bp, Artificial Sequence
  Description of Artificial Sequence: Synthetic heavy chain variable region
caggtccagcttgtgcagtctgggggaggcgtggtccagtctgggaggtccctgagactctcctgtgcagcgtctggattcaccttcagtgacaatggcatgcactgggtccgccaggctccaggcaaggggctggagtgggtggcaggaatctttcatgatgggagtaataaacaatatgcagaatccgtgaagggccgattcatcatctccagagacaattccaagaacactctctatctgcaaatgaacagcctgagagccgaggacacggctctatatttctgtgcgagagccccttacgatatttggagcggatattgtcttgactactggggccagggaaccctggtcaccgtctcctca

SEQ ID NO: 1074 - protein, 122 aa, Artificial Sequence
  Description of Artificial Sequence: Synthetic heavy chain variable region
QVQLVQSGGGVVQSGRSLRLSCAASGFTFSDNGMHWVRQAPGKGLEWVAGIFHDGSNKQYAESVKGRFIISRDNSKNTLYLQMNSLRAEDTALYFCARAPYDIWSGYCLDYWGQGTLVTVSS

SEQ ID NO: 1075 - protein, 9 aa, Artificial Sequence
  Description of Artificial Sequence: Synthetic heavy chain variable region CDR H1
FTFSDNGMH

SEQ ID NO: 1076 - DNA, 27 bp, Artificial Sequence
  Description of Artificial Sequence: Synthetic heavy chain variable region CDR H1
ttcaccttcagtgacaatggcatgcac

SEQ ID NO: 1077 - protein, 17 aa, Artificial Sequence
  Description of Artificial Sequence: Synthetic heavy chain variable region CDR H2
GIFHDGSNKQYAESVKG

SEQ ID NO: 1078 - DNA, 51 bp, Artificial Sequence
  Description of Artificial Sequence: Synthetic heavy chain variable region CDR H2
ggaatctttcatgatgggagtaataaacaatatgcagaatccgtgaagggc

SEQ ID NO: 1079 - protein, 15 aa, Artificial Sequence
  Description of Artificial Sequence: Synthetic heavy chain variable region CDR H3
ARAPYDIWSGYCLDY

SEQ ID NO: 1080 - DNA, 45 bp, Artificial Sequence
  Description of Artificial Sequence: Synthetic heavy chain variable region CDR H3
gcgagagccccttacgatatttggagcggatattgtcttgactac

SEQ ID NO: 1081 - DNA, 321 bp, Artificial Sequence
  Description of Artificial Sequence: Synthetic light chain variable region
gacatccggatgacccagtctccagccaccctgtctctgtctccaggggaaagcgccaccctctcctgcagggccagtcagagtgttatcaacaacttagcctggtaccagcagagacctggccaggctcccaggctcctcatctatggtgcatctaccagggccactggtatcccagccaggttcagtggcagtgggtctgagacagagttcactctcactatcagcagcctgcagtctgaagatttcgcggtttatcactgtcagcagtatagtatctggcctcagacttttggccaggggaccaagctggagatcaaa

SEQ ID NO: 1082 - protein, 107 aa, Artificial Sequence
  Description of Artificial Sequence: Synthetic light chain variable region
DIRMTQSPATLSLSPGESATLSCRASQSVINNLAWYQQRPGQAPRLLIYGASTRATGIPARFSGSGSETEFTLTISSLQSEDFAVYHCQQYSIWPQTFGQGTKLEIK

SEQ ID NO: 1083 - protein, 11 aa, Artificial Sequence
  Description of Artificial Sequence: Synthetic light chain variable region CDR L1
RASQSVINNLA

SEQ ID NO: 1084 - DNA, 33 bp, Artificial Sequence
  Description of Artificial Sequence: Synthetic light chain variable region CDR L1
agggccagtcagagtgttatcaacaacttagcc

SEQ ID NO: 1085 - protein, 7 aa, Artificial Sequence
  Description of Artificial Sequence: Synthetic light chain variable region CDR L2
GASTRAT

SEQ ID NO: 1086 - DNA, 21 bp, Artificial Sequence
  Description of Artificial Sequence: Synthetic light chain variable region CDR L2
ggtgcatctaccagggccact

SEQ ID NO: 1087 - protein, 9 aa, Artificial Sequence
  Description of Artificial Sequence: Synthetic light chain variable region CDR L3
QQYSIWPQT

SEQ ID NO: 1088 - DNA, 27 bp, Artificial Sequence
  Description of Artificial Sequence: Synthetic light chain variable region CDR L3
cagcagtatagtatctggcctcagact

SEQ ID NO: 1089 - DNA, 366 bp, Artificial Sequence
  Description of Artificial Sequence: Synthetic heavy chain variable region
gaggtgcagctgttggagtccgggggaggcgtggtccagtctgggaggtccctgagactctcctgtgtagcgtctggattcaccttcagtgacagtggcatgcactgggtccgccaggctccaggcaaggggctggagtgggtggcaggtttattttatgatggaagtaataaacaatatgcagactccgtgaagggccgattcaccatctccagagacaattccaagagcacactgtatctgcagatgaacagcctgagggccgaggacacggctgtttattactgtgcgagagccccttacgatatttggagtggttattgtcttgactactggggccagggaaccctggtcactgtctcctca

SEQ ID NO: 1090 - protein, 122 aa, Artificial Sequence
  Description of Artificial Sequence: Synthetic heavy chain variable region
EVQLLESGGGVVQSGRSLRLSCVASGFTFSDSGMHWVRQAPGKGLEWVAGLFYDGSNKQYADSVKGRFTISRDNSKSTLYLQMNSLRAEDTAVYYCARAPYDIWSGYCLDYWGQGTLVTVSS

SEQ ID NO: 1091 - protein, 9 aa, Artificial Sequence
  Description of Artificial Sequence: Synthetic heavy chain variable region CDR H1
FTFSDSGMH

SEQ ID NO: 1092 - DNA, 27 bp, Artificial Sequence
  Description of Artificial Sequence: Synthetic heavy chain variable region CDR H1
ttcaccttcagtgacagtggcatgcac

SEQ ID NO: 1093 - protein, 17 aa, Artificial Sequence
  Description of Artificial Sequence: Synthetic heavy chain variable region CDR H2
GLFYDGSNKQYADSVKG

SEQ ID NO: 1094 - DNA, 51 bp, Artificial Sequence
  Description of Artificial Sequence: Synthetic heavy chain variable region CDR H2
ggtttattttatgatggaagtaataaacaatatgcagactccgtgaagggc

SEQ ID NO: 1095 - protein, 15 aa, Artificial Sequence
  Description of Artificial Sequence: Synthetic heavy chain variable region CDR H3
ARAPYDIWSGYCLDY

SEQ ID NO: 1096 - DNA, 45 bp, Artificial Sequence; identical to SEQ ID NO: 312
  Description of Artificial Sequence: Synthetic heavy chain variable region CDR H3

SEQ ID NO: 1097 - DNA, 321 bp, Artificial Sequence
  Description of Artificial Sequence: Synthetic light chain variable region
gaaattgtattgacacagtctccagccaccctgtatatgtctccaggggaaagagccaccctctcctgcagggccagtcagagtgttaacaacaacttagcctggtaccagcagagacctggccaggctcccaggctcctcatctatggtgcatctaccagggccactggtatcccagccaggttcagtggcagtgggtctgagacagagttcactctcactatcagcagcctgcagtctgaagattttgcggtttatcactgtcagcagtatagtatctggcctcagacttttggccaggggaccaagctggagatcaaa

SEQ ID NO: 1098 - protein, 107 aa, Artificial Sequence
  Description of Artificial Sequence: Synthetic light chain variable region
EIVLTQSPATLYMSPGERATLSCRASQSVNNNLAWYQQRPGQAPRLLIYGASTRATGIPARFSGSGSETEFTLTISSLQSEDFAVYHCQQYSIWPQTFGQGTKLEIK

SEQ ID NO: 1099 - protein, 11 aa, Artificial Sequence
  Description of Artificial Sequence: Synthetic light chain variable region CDR L1
RASQSVNNNLA

SEQ ID NO: 1100 - DNA, 33 bp, Artificial Sequence; identical to SEQ ID NO: 316
  Description of Artificial Sequence: Synthetic light chain variable region CDR L1

SEQ ID NO: 1101 - protein, 7 aa, Artificial Sequence
  Description of Artificial Sequence: Synthetic light chain variable region CDR L2
GASTRAT

SEQ ID NO: 1102 - DNA, 21 bp, Artificial Sequence
  Description of Artificial Sequence: Synthetic light chain variable region CDR L2
ggtgcatctaccagggccact

SEQ ID NO: 1103 - protein, 9 aa, Artificial Sequence
  Description of Artificial Sequence: Synthetic light chain variable region CDR L3
QQYSIWPQT

SEQ ID NO: 1104 - DNA, 27 bp, Artificial Sequence
  Description of Artificial Sequence: Synthetic light chain variable region CDR L3
cagcagtatagtatctggcctcagact

SEQ ID NO: 1105 - DNA, 363 bp, Artificial Sequence
  Description of Artificial Sequence: Synthetic heavy chain variable region
caggtccagctggtgcagtctggagctgaggtgaagaagcctggggcctcagtgaaggtctcgtgcaagacttctggttacaccttttccaactacggtatcagctggctgcgacaggcccctggacaagggcttgagtggatggcatggatcagcccttataatgggaacacaaagtctgcacagaggtttcagggcagagtcatcatgaccacagacacatccacgaggacagcccacatggaggtgaagagcctgagaactgacgacacggccacatattactgtgcgagagatccagcagtcgatgcaataccgatgcttgactactggggccagggaaccatggtcaccgtctcctca

SEQ ID NO: 1106 - protein, 121 aa, Artificial Sequence
  Description of Artificial Sequence: Synthetic heavy chain variable region
QVQLVQSGAEVKKPGASVKVSCKTSGYTFSNYGISWLRQAPGQGLEWMAWISPYNGNTKSAQRFQGRVIMTTDTSTRTAHMEVKSLRTDDTATYYCARDPAVDAIPMLDYWGQGTMVTVSS

SEQ ID NO: 1107 - protein, 9 aa, Artificial Sequence
  Description of Artificial Sequence: Synthetic heavy chain variable region CDR H1
YTFSNYGIS

SEQ ID NO: 1108 - DNA, 27 bp, Artificial Sequence
  Description of Artificial Sequence: Synthetic heavy chain variable region CDR H1
tacaccttttccaactacggtatcagc

SEQ ID NO: 1109 - protein, 17 aa, Artificial Sequence
  Description of Artificial Sequence: Synthetic heavy chain variable region CDR H2
WISPYNGNTKSAQRFQG

SEQ ID NO: 1110 - DNA, 51 bp, Artificial Sequence; identical to SEQ ID NO: 1046
  Description of Artificial Sequence: Synthetic heavy chain variable region CDR H2

SEQ ID NO: 1111 - protein, 14 aa, Artificial Sequence
  Description of Artificial Sequence: Synthetic heavy chain variable region CDR H3
ARDPAVDAIPMLDY

SEQ ID NO: 1112 - DNA, 42 bp, Artificial Sequence; identical to SEQ ID NO: 1048
  Description of Artificial Sequence: Synthetic heavy chain variable region CDR H3

SEQ ID NO: 1113 - DNA, 336 bp, Artificial Sequence
  Description of Artificial Sequence: Synthetic light chain variable region
gaaattgtgttgacacagtctccactctccctgcccgtcacccttggacagccggcctccatctcctgcaggtctagtcaaagcctcgtgtacactgatggaaacacctacttgagctggtttcagcagaggccaggccaatctccaaggcgcctaatttatagggtttctcaccgggactctggggtcccagacagattcaccggcagtgggtcaggcactgatttcacactgataatccgcagggtggaggctgaggatgttggggtttattactgcatgcaaggtacacactggcctctcactttcggcggagggaccaaggtggaaatcaaa

SEQ ID NO: 1114 - protein, 112 aa, Artificial Sequence
  Description of Artificial Sequence: Synthetic light chain variable region
EIVLTQSPLSLPVTLGQPASISCRSSQSLVYTDGNTYLSWFQQRPGQSPRRLIYRVSHRDSGVPDRFTGSGSGTDFTLIIRRVEAEDVGVYYCMQGTHWPLTFGGGTKVEIK

SEQ ID NO: 1115 - protein, 16 aa, Artificial Sequence
  Description of Artificial Sequence: Synthetic light chain variable region CDR L1
RSSQSLVYTDGNTYLS

SEQ ID NO: 1116 - DNA, 48 bp, Artificial Sequence; identical to SEQ ID NO: 1052
  Description of Artificial Sequence: Synthetic light chain variable region CDR L1

SEQ ID NO: 1117 - protein, 7 aa, Artificial Sequence
  Description of Artificial Sequence: Synthetic light chain variable region CDR L2
RVSHRDS

SEQ ID NO: 1118 - DNA, 21 bp, Artificial Sequence
  Description of Artificial Sequence: Synthetic light chain variable region CDR L2
agggtttctcaccgggactct

SEQ ID NO: 1119 - protein, 9 aa, Artificial Sequence
  Description of Artificial Sequence: Synthetic light chain variable region CDR L3
MQGTHWPLT

SEQ ID NO: 1120 - DNA, 27 bp, Artificial Sequence
  Description of Artificial Sequence: Synthetic light chain variable region CDR L3
atgcaaggtacacactggcctctcact

SEQ ID NO: 1121 - DNA, 348 bp, Artificial Sequence
  Description of Artificial Sequence: Synthetic heavy chain variable region
gaggtgcagctggtggagtcgggcccaagactggtgaggccttcggagaccctgtccctcacctgcactgtctctggaggcttcatcaaaactagtagttactactggggctggatccgtcagcccccagggaaggggctagagtggattgggagtatctattatgctgggaccacctactacaacccgtccctccagagtcgagtcaccatgtccgttgacacgtcgaacaaccagttctccctgaagctgaactctgtgaccgccgcagacacggctgtatattactgtgcgaccgcctggacttttgaccactggggccagggaaccctggtcactgtctcctca

SEQ ID NO: 1122 - protein, 116 aa, Artificial Sequence
  Description of Artificial Sequence: Synthetic heavy chain variable region
EVQLVESGPRLVRPSETLSLTCTVSGGFIKTSSYYWGWIRQPPGKGLEWIGSIYYAGTTYYNPSLQSRVTMSVDTSNNQFSLKLNSVTAADTAVYYCATAWTFDHWGQGTLVTVSS

SEQ ID NO: 1123 - protein, 11 aa, Artificial Sequence
  Description of Artificial Sequence: Synthetic heavy chain variable region CDR H1
GFIKTSSYYWG

SEQ ID NO: 1124 - DNA, 33 bp, Artificial Sequence
  Description of Artificial Sequence: Synthetic heavy chain variable region CDR H1
ggcttcatcaaaactagtagttactactggggc

SEQ ID NO: 1125 - protein, 16 aa, Artificial Sequence
  Description of Artificial Sequence: Synthetic heavy chain variable region CDR H2
SIYYAGTTYYNPSLQS

SEQ ID NO: 1126 - DNA, 48 bp, Artificial Sequence
  Description of Artificial Sequence: Synthetic heavy chain variable region CDR H2
agtatctattatgctgggaccacctactacaacccgtccctccagagt

SEQ ID NO: 1127 - protein, 8 aa, Artificial Sequence
  Description of Artificial Sequence: Synthetic heavy chain variable region CDR H3
ATAWTFDH

SEQ ID NO: 1128 - DNA, 24 bp, Artificial Sequence
  Description of Artificial Sequence: Synthetic heavy chain variable region CDR H3
gcgaccgcctggacttttgaccac

SEQ ID NO: 1129 - DNA, 327 bp, Artificial Sequence
  Description of Artificial Sequence: Synthetic light chain variable region
gaaattgtattgacacagtctccagccaccctgtccttgtctccaggggaaagagccaccctctcctgcagggccagtcagagtcttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagctgcgtggccactggccccccacgatcaccttcggccaagggacacgactggagattaaa

SEQ ID NO: 1130 - protein, 109 aa, Artificial Sequence
  Description of Artificial Sequence: Synthetic light chain variable region
EIVLTQSPATLSLSPGERATLSCRASQSLSNYLAWYQQKPGQAPRLLIYDASNRATGIPARFSGSGSGTDFTLTISSLEPEDFAVYYCQLRGHWPPTITFGQGTRLEIK

SEQ ID NO: 1131 - protein, 11 aa, Artificial Sequence
  Description of Artificial Sequence: Synthetic light chain variable region CDR L1
RASQSLSNYLA

SEQ ID NO: 1132 - DNA, 33 bp, Artificial Sequence
  Description of Artificial Sequence: Synthetic light chain variable region CDR L1
agggccagtcagagtcttagcaactacttagcc

SEQ ID NO: 1133 - protein, 7 aa, Artificial Sequence
  Description of Artificial Sequence: Synthetic light chain variable region CDR L2
DASNRAT

SEQ ID NO: 1134 - DNA, 21 bp, Artificial Sequence
  Description of Artificial Sequence: Synthetic light chain variable region CDR L2
gatgcatccaacagggccact

SEQ ID NO: 1135 - protein, 11 aa, Artificial Sequence
  Description of Artificial Sequence: Synthetic light chain variable region CDR L3
QLRGHWPPTIT

SEQ ID NO: 1136 - DNA, 33 bp, Artificial Sequence
  Description of Artificial Sequence: Synthetic light chain variable region CDR L3
cagctgcgtggccactggccccccacgatcacc

SEQ ID NO: 1137 - DNA, 369 bp, Artificial Sequence
  Description of Artificial Sequence: Synthetic heavy chain variable region
caggtccagcttgtacagtctgggggaggcttggttcagccgggggggtccctgagactctcctgtgcagcctctggattcgcctttagcgactataccatgagctgggtccgccaggctccagggaaggggctggagtgggtctcaagtgttagtggcacgggtggtacctcatactacgcagactccgtgaatggccggttcgccatctccagagagaattccaagaacacgctgtttctgcaaatggacagcctgagagccgaggacacggccacttactactgtgccaaagatgggttgagggacgtatcgagggtttattacatcgacgtctggggcaaagggaccacggtcaccgtctcctca

SEQ ID NO: 1138 - protein, 123 aa, Artificial Sequence
  Description of Artificial Sequence: Synthetic heavy chain variable region
QVQLVQSGGGLVQPGGSLRLSCAASGFAFSDYTMSWVRQAPGKGLEWVSSVSGTGGTSYYADSVNGRFAISRENSKNTLFLQMDSLRAEDTATYYCAKDGLRDVSRVYYIDVWGKGTTVTVSS

SEQ ID NO: 1139 - protein, 9 aa, Artificial Sequence
  Description of Artificial Sequence: Synthetic heavy chain variable region CDR H1
FAFSDYTMS

SEQ ID NO: 1140 - DNA, 27 bp, Artificial Sequence
  Description of Artificial Sequence: Synthetic heavy chain variable region CDR H1
ttcgcctttagcgactataccatgagc

SEQ ID NO: 1141 - protein, 17 aa, Artificial Sequence
  Description of Artificial Sequence: Synthetic heavy chain variable region CDR H2
SVSGTGGTSYYADSVNG

SEQ ID NO: 1142 - DNA, 51 bp, Artificial Sequence
  Description of Artificial Sequence: Synthetic heavy chain variable region CDR H2
agtgttagtggcacgggtggtacctcatactacgcagactccgtgaatggc

SEQ ID NO: 1143 - protein, 16 aa, Artificial Sequence
  Description of Artificial Sequence: Synthetic heavy chain variable region CDR H3
AKDGLRDVSRVYYIDV

SEQ ID NO: 1144 - DNA, 48 bp, Artificial Sequence
  Description of Artificial Sequence: Synthetic heavy chain variable region CDR H3
gccaaagatgggttgagggacgtatcgagggtttattacatcgacgtc

SEQ ID NO: 1145 - DNA, 333 bp, Artificial Sequence
  Description of Artificial Sequence: Synthetic light chain variable region
cagcctgtgctgactcagcctgcctccgtgtctgggtctcctggacagtcgatcaccatctcctgcactggaaccagccgtgacattggttctcatgactctgtctcctggtaccaacaaaagccaggcaaagcccccaaactcatcatttatgcagtcagaaatcggccctcagggctttctaatcgcttctctggttccaagtctggcaacacggcctccctgaccatctctgggctccagactgaagacgaaggtgactattactgcagctcatatagaaacggcaacgctctgggggtcttcggaactgggaccaaggtcaccgtcctc

SEQ ID NO: 1146 - protein, 111 aa, Artificial Sequence
  Description of Artificial Sequence: Synthetic light chain variable region
QPVLTQPASVSGSPGQSITISCTGTSRDIGSHDSVSWYQQKPGKAPKLIIYAVRNRPSGLSNRFSGSKSGNTASLTISGLQTEDEGDYYCSSYRNGNALGVFGTGTKVTVL

SEQ ID NO: 1147 - protein, 14 aa, Artificial Sequence
  Description of Artificial Sequence: Synthetic light chain variable region CDR L1
TGTSRDIGSHDSVS

SEQ ID NO: 1148 - DNA, 42 bp, Artificial Sequence
  Description of Artificial Sequence: Synthetic light chain variable region CDR L1
actggaaccagccgtgacattggttctcatgactctgtctcc

SEQ ID NO: 1149 - protein, 7 aa, Artificial Sequence
  Description of Artificial Sequence: Synthetic light chain variable region CDR L2
AVRNRPS

SEQ ID NO: 1150 - DNA, 21 bp, Artificial Sequence
  Description of Artificial Sequence: Synthetic light chain variable region CDR L2
gcagtcagaaatcggccctca

SEQ ID NO: 1151 - protein, 11 aa, Artificial Sequence
  Description of Artificial Sequence: Synthetic light chain variable region CDR L3
SSYRNGNALGV

SEQ ID NO: 1152 - DNA, 33 bp, Artificial Sequence
  Description of Artificial Sequence: Synthetic light chain variable region CDR L3
agctcatatagaaacggcaacgctctgggggtc

SEQ ID NO: 1153 - DNA, 369 bp, Artificial Sequence
  Description of Artificial Sequence: Synthetic heavy chain variable region
caggtgcagctggtggagtctgggggaggcttggttcagccgggggggtccctgagactctcctgtgcagcctctggattcgcctttagcaactatgccatgagctgggtccgccaggctccagggaagggcctggagtgggtctcaagtgttagtggcacgggtggtaccacatactacgcagactccgtgaacgggcggttcgccatctccagagagaattccaggaacaccctctatctgcaaatggatagcctgagagtcgaggacacggccacttattactgtgccaaagatgggttgagggacttatcgagggtctattacatcgacgtctggggcaaaggggccacggtcaccgtctcttca

SEQ ID NO: 1154 - protein, 123 aa, Artificial Sequence
  Description of Artificial Sequence: Synthetic heavy chain variable region
QVQLVESGGGLVQPGGSLRLSCAASGFAFSNYAMSWVRQAPGKGLEWVSSVSGTGGTTYYADSVNGRFAISRENSRNTLYLQMDSLRVEDTATYYCAKDGLRDLSRVYYIDVWGKGATVTVSS

SEQ ID NO: 1155 - protein, 9 aa, Artificial Sequence
  Description of Artificial Sequence: Synthetic heavy chain variable region CDR H1
FAFSNYAMS

SEQ ID NO: 1156 - DNA, 27 bp, Artificial Sequence
  Description of Artificial Sequence: Synthetic heavy chain variable region CDR H1
ttcgcctttagcaactatgccatgagc

SEQ ID NO: 1157 - protein, 17 aa, Artificial Sequence
  Description of Artificial Sequence: Synthetic heavy chain variable region CDR H2
SVSGTGGTTYYADSVNG

SEQ ID NO: 1158 - DNA, 51 bp, Artificial Sequence
  Description of Artificial Sequence: Synthetic heavy chain variable region CDR H2
agtgttagtggcacgggtggtaccacatactacgcagactccgtgaacggg

SEQ ID NO: 1159 - protein, 16 aa, Artificial Sequence
  Description of Artificial Sequence: Synthetic heavy chain variable region CDR H3
AKDGLRDLSRVYYIDV

SEQ ID NO: 1160 - DNA, 48 bp, Artificial Sequence
  Description of Artificial Sequence: Synthetic heavy chain variable region CDR H3
gccaaagatgggttgagggacttatcgagggtctattacatcgacgtc

SEQ ID NO: 1161 - DNA, 333 bp, Artificial Sequence
  Description of Artificial Sequence: Synthetic light chain variable region
cagtctgtcctgactcagcctgcctccgtgtctgggtctcctggacagtcgatcaccatctcctgcactggaaccagccgtgacattggtagtcatgactatgtctcctggtaccaacaacacccaggcaaagcccccaaactcatcatttatggggtcaataatcggccctcaggactttctaatcgcttctctggttccaagtctggcaacacggcctccctgaccatctctgggctccagactgaagacgaaggtgactattactgcagctcatatagaaacggcaacactctgggggtcttcggaactgggaccaagctcaccgtccta

SEQ ID NO: 1162 - protein, 111 aa, Artificial Sequence
  Description of Artificial Sequence: Synthetic light chain variable region
QSVLTQPASVSGSPGQSITISCTGTSRDIGSHDYVSWYQQHPGKAPKLIIYGVNNRPSGLSNRFSGSKSGNTASLTISGLQTEDEGDYYCSSYRNGNTLGVFGTGTKLTVL

SEQ ID NO: 1163 - protein, 14 aa, Artificial Sequence
  Description of Artificial Sequence: Synthetic light chain variable region CDR L1
TGTSRDIGSHDYVS

SEQ ID NO: 1164 - DNA, 42 bp, Artificial Sequence
  Description of Artificial Sequence: Synthetic light chain variable region CDR L1
actggaaccagccgtgacattggtagtcatgactatgtctcc

SEQ ID NO: 1165 - protein, 7 aa, Artificial Sequence
  Description of Artificial Sequence: Synthetic light chain variable region CDR L2
GVNNRPS

SEQ ID NO: 1166 - DNA, 21 bp, Artificial Sequence
  Description of Artificial Sequence: Synthetic light chain variable region CDR L2
ggggtcaataatcggccctca

SEQ ID NO: 1167 - protein, 11 aa, Artificial Sequence
  Description of Artificial Sequence: Synthetic light chain variable region CDR L3
SSYRNGNTLGV

SEQ ID NO: 1168 - DNA, 33 bp, Artificial Sequence
  Description of Artificial Sequence: Synthetic light chain variable region CDR L3
agctcatatagaaacggcaacactctgggggtc

SEQ ID NO: 1169 - DNA, 375 bp, Artificial Sequence
  Description of Artificial Sequence: Synthetic heavy chain variable region
caggtccagctggtacagtctggggctgaggtgaagaagcctgggtcctcggtgaaggtctcctgcaaggcctctggaggcaccttcagcggctacgctatcaactgggtgcgacaggcccctggacaagggctcgagtggatgggagggatcatccatatatttgggacagtaaactacgctccgaagttccagggcagactcacgataaccgcggacgcatccacgggcacagcctacatggaattgagcagcctgatgtctgaggacacggccctatattattgtgcgagagatgcttacgaagtgtggaccggttcttatctccccccttttgactactggggccagggaaccctggtcaccgtctcctca

SEQ ID NO: 1170 - protein, 125 aa, Artificial Sequence
  Description of Artificial Sequence: Synthetic heavy chain variable region
QVQLVQSGAEVKKPGSSVKVSCKASGGTFSGYAINWVRQAPGQGLEWMGGIIHIFGTVNYAPKFQGRLTITADASTGTAYMELSSLMSEDTALYYCARDAYEVWTGSYLPPFDYWGQGTLVTVSS

SEQ ID NO: 1171 - protein, 9 aa, Artificial Sequence
  Description of Artificial Sequence: Synthetic heavy chain variable region CDR H1
GTFSGYAIN

SEQ ID NO: 1172 - DNA, 27 bp, Artificial Sequence
  Description of Artificial Sequence: Synthetic heavy chain variable region CDR H1
ggcaccttcagcggctacgctatcaac

SEQ ID NO: 1173 - protein, 17 aa, Artificial Sequence
  Description of Artificial Sequence: Synthetic heavy chain variable region CDR H2
GIIHIFGTVNYAPKFQG

SEQ ID NO: 1174 - DNA, 51 bp, Artificial Sequence
  Description of Artificial Sequence: Synthetic heavy chain variable region CDR H2
gggatcatccatatatttgggacagtaaactacgctccgaagttccagggc

SEQ ID NO: 1175 - protein, 18 aa, Artificial Sequence
  Description of Artificial Sequence: Synthetic heavy chain variable region CDR H3
ARDAYEVWTGSYLPPFDY

SEQ ID NO: 1176 - DNA, 54 bp, Artificial Sequence
  Description of Artificial Sequence: Synthetic heavy chain variable region CDR H3
gcgagagatgcttacgaagtgtggaccggttcttatctccccccttttgactac

SEQ ID NO: 1177 - DNA, 324 bp, Artificial Sequence
  Description of Artificial Sequence: Synthetic light chain variable region
gaaacgacactcacgcagtctccaggcaccctgtctttgtctcccggggaaagagtcaccctctcctgcagggccagtcagactgttacaagcaactacttagcctggtaccagcagaaacctggccaggctcccaggctcctcatctatgatgcattcaccagggccactggcgtcccagccaggttcagtggcagtgggtctgggacagacttcactctcaccatcagcagactggagcctgaagattttgcagtttactattgtcagcagtatggtagctcattcctcactttcggcggagggaccaaggtggaaatcaaa

SEQ ID NO: 1178 - protein, 108 aa, Artificial Sequence
  Description of Artificial Sequence: Synthetic light chain variable region
ETTLTQSPGTLSLSPGERVTLSCRASQTVTSNYLAWYQQKPGQAPRLLIYDAFTRATGVPARFSGSGSGTDFTLTISRLEPEDFAVYYCQQYGSSFLTFGGGTKVEIK

SEQ ID NO: 1179 - protein, 12 aa, Artificial Sequence
  Description of Artificial Sequence: Synthetic light chain variable region CDR L1
RASQTVTSNYLA

SEQ ID NO: 1180 - DNA, 36 bp, Artificial Sequence; identical to SEQ ID NO: 220
  Description of Artificial Sequence: Synthetic light chain variable region CDR L1

SEQ ID NO: 1181 - protein, 7 aa, Artificial Sequence
  Description of Artificial Sequence: Synthetic light chain variable region CDR L2
DAFTRAT

SEQ ID NO: 1182 - DNA, 21 bp, Artificial Sequence
  Description of Artificial Sequence: Synthetic light chain variable region CDR L2
gatgcattcaccagggccact

SEQ ID NO: 1183 - protein, 9 aa, Artificial Sequence
  Description of Artificial Sequence: Synthetic light chain variable region CDR L3
QQYGSSFLT

SEQ ID NO: 1184 - DNA, 27 bp, Artificial Sequence
  Description of Artificial Sequence: Synthetic light chain variable region CDR L3
cagcagtatggtagctcattcctcact

SEQ ID NO: 1185 - DNA, 366 bp, Artificial Sequence
  Description of Artificial Sequence: Synthetic heavy chain variable region
gaggtgcagctggtggagtctgggggaggcgtggtccagtctgggaggtccctgagactctcctgtgcagcatctggattcatcttcagtgacaatggcatgcactgggtccgccaggctccaggcaaggggctggagtgggtggcaggtattttttatgatggaagtaataaacaatatgcagactccgtgaagggccgattcaccatctccagagacaattccaagaacacactgtatctgcaaatgaagagcctgagagccgaggacacggctgtgtattactgtgcgagagccccttacgatatctggagtggttattgtcttgactactggggccagggaaccctggtcaccgtctcctca

SEQ ID NO: 1186 - protein, 122 aa, Artificial Sequence
  Description of Artificial Sequence: Synthetic heavy chain variable region
EVQLVESGGGVVQSGRSLRLSCAASGFIFSDNGMHWVRQAPGKGLEWVAGIFYDGSNKQYADSVKGRFTISRDNSKNTLYLQMKSLRAEDTAVYYCARAPYDIWSGYCLDYWGQGTLVTVSS

SEQ ID NO: 1187 - protein, 9 aa, Artificial Sequence
  Description of Artificial Sequence: Synthetic heavy chain variable region CDR H1
FIFSDNGMH

SEQ ID NO: 1188 - DNA, 27 bp, Artificial Sequence
  Description of Artificial Sequence: Synthetic heavy chain variable region CDR H1
ttcatcttcagtgacaatggcatgcac

SEQ ID NO: 1189 - protein, 17 aa, Artificial Sequence
  Description of Artificial Sequence: Synthetic heavy chain variable region CDR H2
GIFYDGSNKQYADSVKG

SEQ ID NO: 1190 - DNA, 51 bp, Artificial Sequence
  Description of Artificial Sequence: Synthetic heavy chain variable region CDR H2
ggtattttttatgatggaagtaataaacaatatgcagactccgtgaagggc

SEQ ID NO: 1191 - protein, 15 aa, Artificial Sequence
  Description of Artificial Sequence: Synthetic heavy chain variable region CDR H3
ARAPYDIWSGYCLDY

SEQ ID NO: 1192 - DNA, 45 bp, Artificial Sequence
  Description of Artificial Sequence: Synthetic heavy chain variable region CDR H3
gcgagagccccttacgatatctggagtggttattgtcttgactac

SEQ ID NO: 1193 - DNA, 321 bp, Artificial Sequence
  Description of Artificial Sequence: Synthetic light chain variable region
gacatccaggtgacccagtctccagccaccctgtctatgtctccaggggaaagagccaccctctcctgcagggccagtcagagtgttaacaacaacttagcctggtaccagcagagacctggccaggctcccaggctcctcatctatggtgcatctacgagggccactggtatcccagccaggttcagtggcagtgggtctgagacagagttcactctcactatcagcagcctgcagtctgaagattttgcggtttatcactgtcagcagtatagtatctggcctcagacttttggccaggggaccaaggtggaaatcaaa

SEQ ID NO: 1194 - protein, 107 aa, Artificial Sequence
  Description of Artificial Sequence: Synthetic light chain variable region
DIQVTQSPATLSMSPGERATLSCRASQSVNNNLAWYQQRPGQAPRLLIYGASTRATGIPARFSGSGSETEFTLTISSLQSEDFAVYHCQQYSIWPQTFGQGTKVEIK

SEQ ID NO: 1195 - protein, 11 aa, Artificial Sequence
  Description of Artificial Sequence: Synthetic light chain variable region CDR L1
RASQSVNNNLA

SEQ ID NO: 1196 - DNA, 33 bp, Artificial Sequence; identical to SEQ ID NO: 316
  Description of Artificial Sequence: Synthetic light chain variable region CDR L1

SEQ ID NO: 1197 - protein, 7 aa, Artificial Sequence
  Description of Artificial Sequence: Synthetic light chain variable region CDR L2
GASTRAT

SEQ ID NO: 1198 - DNA, 21 bp, Artificial Sequence
  Description of Artificial Sequence: Synthetic light chain variable region CDR L2
ggtgcatctacgagggccact

SEQ ID NO: 1199 - protein, 9 aa, Artificial Sequence
  Description of Artificial Sequence: Synthetic light chain variable region CDR L3
QQYSIWPQT

SEQ ID NO: 1200 - DNA, 27 bp, Artificial Sequence
  Description of Artificial Sequence: Synthetic light chain variable region CDR L3
cagcagtatagtatctggcctcagact

SEQ ID NO: 1201 - DNA, 360 bp, Artificial Sequence
  Description of Artificial Sequence: Synthetic heavy chain variable region
caggtccagcttgtacagtctggggctgaactaaagaagcctggctcctcggtgaaagtctcctgcaaggcttctgcagacaccttcaaaagttatgctatcaactgggtgcggcaggcccctggacaaggacttgagtggatgggagagttcatcccaatctttggtgtctcaccctccgcacagaagttccagggcagagtcaccattaccgcggacagatccacgtccacagcctacatggagttgagcagcctgaaatctgatgactcggccatttattactgtgcgacacgtctgtatacgttggggtccccttttgacaattggggccaggggaccacggtcaccgtctcctca

SEQ ID NO: 1202 - protein, 120 aa, Artificial Sequence
  Description of Artificial Sequence: Synthetic heavy chain variable region
QVQLVQSGAELKKPGSSVKVSCKASADTFKSYAINWVRQAPGQGLEWMGEFIPIFGVSPSAQKFQGRVTITADRSTSTAYMELSSLKSDDSAIYYCATRLYTLGSPFDNWGQGTTVTVSS

SEQ ID NO: 1203 - protein, 9 aa, Artificial Sequence
  Description of Artificial Sequence: Synthetic heavy chain variable region CDR H1
DTFKSYAIN

SEQ ID NO: 1204 - DNA, 27 bp, Artificial Sequence
  Description of Artificial Sequence: Synthetic heavy chain variable region CDR H1
gacaccttcaaaagttatgctatcaac

SEQ ID NO: 1205 - protein, 17 aa, Artificial Sequence
  Description of Artificial Sequence: Synthetic heavy chain variable region CDR H2
EFIPIFGVSPSAQKFQG

SEQ ID NO: 1206 - DNA, 51 bp, Artificial Sequence
  Description of Artificial Sequence: Synthetic heavy chain variable region CDR H2
gagttcatcccaatctttggtgtctcaccctccgcacagaagttccagggc

SEQ ID NO: 1207 - protein, 13 aa, Artificial Sequence
  Description of Artificial Sequence: Synthetic heavy chain variable region CDR H3
ATRLYTLGSPFDN

SEQ ID NO: 1208 - DNA, 39 bp, Artificial Sequence
  Description of Artificial Sequence: Synthetic heavy chain variable region CDR H3
gcgacacgtctgtatacgttggggtccccttttgacaat

SEQ ID NO: 1209 - DNA, 330 bp, Artificial Sequence
  Description of Artificial Sequence: Synthetic light chain variable region
cagcctgtgctgactcagcctcgctcagtgtccgggtctcctggacagtcagtcaccatctcctgcactggaaccagtagtgatgttggtgattatgactatgtctcctggtaccaacacctcccaggcgaagtccccaaactcatagtttataatgtcattaagcggccctctggggtccctgatcgcttctctggctccaagtctggcaacacggcctccctgaccatctctgggctccaggctgaggatgaggctgactattactgctgctcatatgcaggcaggtatatttatgtcttcggcagtgggaccaagctcaccgtccta

SEQ ID NO: 1210 - protein, 110 aa, Artificial Sequence
  Description of Artificial Sequence: Synthetic light chain variable region
QPVLTQPRSVSGSPGQSVTISCTGTSSDVGDYDYVSWYQHLPGEVPKLIVYNVIKRPSGVPDRFSGSKSGNTASLTISGLQAEDEADYYCCSYAGRYIYVFGSGTKLTVL

SEQ ID NO: 1211 - protein, 14 aa, Artificial Sequence
  Description of Artificial Sequence: Synthetic light chain variable region CDR L1
TGTSSDVGDYDYVS

SEQ ID NO: 1212 - DNA, 42 bp, Artificial Sequence
  Description of Artificial Sequence: Synthetic light chain variable region CDR L1
actggaaccagtagtgatgttggtgattatgactatgtctcc

SEQ ID NO: 1213 - protein, 7 aa, Artificial Sequence
  Description of Artificial Sequence: Synthetic light chain variable region CDR L2
NVIKRPS

SEQ ID NO: 1214 - DNA, 21 bp, Artificial Sequence
  Description of Artificial Sequence: Synthetic light chain variable region CDR L2
aatgtcattaagcggccctct

SEQ ID NO: 1215 - protein, 10 aa, Artificial Sequence
  Description of Artificial Sequence: Synthetic light chain variable region CDR L3
CSYAGRYIYV

SEQ ID NO: 1216 - DNA, 30 bp, Artificial Sequence
  Description of Artificial Sequence: Synthetic light chain variable region CDR L3
tgctcatatgcaggcaggtatatttatgtc

SEQ ID NO: 1217 - DNA, 375 bp, Artificial Sequence
  Description of Artificial Sequence: Synthetic heavy chain variable region
gaggtgcagctgttggagtctgggggaggcctggtcaagcctggggagtccctgagactctcctgtgcagcctctggattcacccttagtggctactacatgaattgggtccgccaggctccagggagggggctggagtgggtctcctccattagtggtggtagtaattacataaactacgccgactcagtgaagggccggttcaccatctccagagacaacgccaagaactcactctatctgcaaatgaacagcctgagagtcgaggacacggctgtctattactgtgcgagggtccacgtggatttagtgactacgatttttggggttgactttgacttctggggccagggaaccctggtcactgtctcctca

SEQ ID NO: 1218 - protein, 125 aa, Artificial Sequence
  Description of Artificial Sequence: Synthetic heavy chain variable region
EVQLLESGGGLVKPGESLRLSCAASGFTLSGYYMNWVRQAPGRGLEWVSSISGGSNYINYADSVKGRFTISRDNAKNSLYLQMNSLRVEDTAVYYCARVHVDLVTTIFGVDFDFWGQGTLVTVSS

SEQ ID NO: 1219 - protein, 9 aa, Artificial Sequence
  Description of Artificial Sequence: Synthetic heavy chain variable region CDR H1
FTLSGYYMN

SEQ ID NO: 1220 - DNA, 27 bp, Artificial Sequence
  Description of Artificial Sequence: Synthetic heavy chain variable region CDR H1
ttcacccttagtggctactacatgaat

SEQ ID NO: 1221 - protein, 17 aa, Artificial Sequence
  Description of Artificial Sequence: Synthetic heavy chain variable region CDR H2
SISGGSNYINYADSVKG

SEQ ID NO: 1222 - DNA, 51 bp, Artificial Sequence
  Description of Artificial Sequence: Synthetic heavy chain variable region CDR H2
tccattagtggtggtagtaattacataaactacgccgactcagtgaagggc

SEQ ID NO: 1223 - protein, 18 aa, Artificial Sequence
  Description of Artificial Sequence: Synthetic heavy chain variable region CDR H3
ARVHVDLVTTIFGVDFDF

SEQ ID NO: 1224 - DNA, 54 bp, Artificial Sequence
  Description of Artificial Sequence: Synthetic heavy chain variable region CDR H3
gcgagggtccacgtggatttagtgactacgatttttggggttgactttgacttc

SEQ ID NO: 1225 - DNA, 333 bp, Artificial Sequence
  Description of Artificial Sequence: Synthetic light chain variable region
cagtctgtgctgacgcagccgccctcagtgtctggggccccagggcagagggtcaccatctcctgcactgggagcagctccaacatcggggcagggtatgatgtacactggtaccagcaacttccaggaacagcccccaaactcctcatctatggtaacaccaatcggcccgcaggggtccctgaccgattctctggctccaagtctggctcctcagcctccctggccatcactgggctccaggctgaggatgaggctgattattactgccagtcgtatgacagcagcctgagtggtgcgatcttcggcggagggaccaagctcaccgtccta

SEQ ID NO: 1226 - protein, 111 aa, Artificial Sequence
  Description of Artificial Sequence: Synthetic light chain variable region
QSVLTQPPSVSGAPGQRVTISCTGSSSNIGAGYDVHWYQQLPGTAPKLLIYGNTNRPAGVPDRFSGSKSGSSASLAITGLQAEDEADYYCQSYDSSLSGAIFGGGTKLTVL

SEQ ID NO: 1227 - protein, 14 aa, Artificial Sequence
  Description of Artificial Sequence: Synthetic light chain variable region CDR L1
TGSSSNIGAGYDVH

SEQ ID NO: 1228 - DNA, 42 bp, Artificial Sequence
  Description of Artificial Sequence: Synthetic light chain variable region CDR L1
actgggagcagctccaacatcggggcagggtatgatgtacac

SEQ ID NO: 1229 - protein, 7 aa, Artificial Sequence
  Description of Artificial Sequence: Synthetic light chain variable region CDR L2
GNTNRPA

SEQ ID NO: 1230 - DNA, 21 bp, Artificial Sequence
  Description of Artificial Sequence: Synthetic light chain variable region CDR L2
ggtaacaccaatcggcccgca

SEQ ID NO: 1231 - protein, 11 aa, Artificial Sequence
  Description of Artificial Sequence: Synthetic light chain variable region CDR L3
QSYDSSLSGAI

SEQ ID NO: 1232 - DNA, 33 bp, Artificial Sequence
  Description of Artificial Sequence: Synthetic light chain variable region CDR L3
cagtcgtatgacagcagcctgagtggtgcgatc

SEQ ID NO: 1233 - DNA, 366 bp, Artificial Sequence
  Description of Artificial Sequence: Synthetic heavy chain variable region
caggtgcagctgcaggagtccggagctgaggtgaagatgcgtggggcctcagtgaaggtctcctgcaaggcttctggttacacctttagtcactatggtatcagttgggtgcgacaggcccctggacaagggctcgagtggatgggatttatcagcgcttacaatcataacacaaagtatgcacagaccgtccagggcagagtcaccttgagcacagacacatccacgagcacagcctacatggagctgaggagcctgagacctgacgacacggccatgtattactgtgcgagagaacccccgagtgacgatgctgcaaggctctttgactactggggccagggaaccctggtcactgtctcctca

SEQ ID NO: 1234 - protein, 122 aa, Artificial Sequence
  Description of Artificial Sequence: Synthetic heavy chain variable region
QVQLQESGAEVKMRGASVKVSCKASGYTFSHYGISWVRQAPGQGLEWMGFISAYNHNTKYAQTVQGRVTLSTDTSTSTAYMELRSLRPDDTAMYYCAREPPSDDAARLFDYWGQGTLVTVSS

SEQ ID NO: 1235 - protein, 9 aa, Artificial Sequence
  Description of Artificial Sequence: Synthetic heavy chain variable region CDR H1
YTFSHYGIS

SEQ ID NO: 1236 - DNA, 27 bp, Artificial Sequence
  Description of Artificial Sequence: Synthetic heavy chain variable region CDR H1
tacacctttagtcactatggtatcagt

SEQ ID NO: 1237 - protein, 17 aa, Artificial Sequence
  Description of Artificial Sequence: Synthetic heavy chain variable region CDR H2
FISAYNHNTKYAQTVQG

SEQ ID NO: 1238 - DNA, 51 bp, Artificial Sequence
  Description of Artificial Sequence: Synthetic heavy chain variable region CDR H2
tttatcagcgcttacaatcataacacaaagtatgcacagaccgtccagggc

SEQ ID NO: 1239 - protein, 15 aa, Artificial Sequence
  Description of Artificial Sequence: Synthetic heavy chain variable region CDR H3
AREPPSDDAARLFDY

SEQ ID NO: 1240 - DNA, 45 bp, Artificial Sequence
  Description of Artificial Sequence: Synthetic heavy chain variable region CDR H3
gcgagagaacccccgagtgacgatgctgcaaggctctttgactac

SEQ ID NO: 1241 - DNA, 336 bp, Artificial Sequence
  Description of Artificial Sequence: Synthetic light chain variable region
gaaacgacactcacgcagtctccacgctccctgcccgtcacccttggacagccggcctccatctcctgcaggtctagtcaaagcctcgtgtacagtgaaggaaacacctacttgagttggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattattgcatgcaaggtacacagtggcctgtgacattcggccaagggaccaaggtggaaatcaaa

SEQ ID NO: 1242 - protein, 112 aa, Artificial Sequence
  Description of Artificial Sequence: Synthetic light chain variable region
ETTLTQSPRSLPVTLGQPASISCRSSQSLVYSEGNTYLSWFQQRPGQSPRRLIYKVSNRDSGVPDRFSGSGSGTDFTLKISRVEAEDVGVYYCMQGTQWPVTFGQGTKVEIK

SEQ ID NO: 1243 - protein, 16 aa, Artificial Sequence
  Description of Artificial Sequence: Synthetic light chain variable region CDR L1
RSSQSLVYSEGNTYLS

SEQ ID NO: 1244 - DNA, 48 bp, Artificial Sequence
  Description of Artificial Sequence: Synthetic light chain variable region CDR L1
aggtctagtcaaagcctcgtgtacagtgaaggaaacacctacttgagt

SEQ ID NO: 1245 - protein, 7 aa, Artificial Sequence
  Description of Artificial Sequence: Synthetic light chain variable region CDR L2
KVSNRDS

SEQ ID NO: 1246 - DNA, 21 bp, Artificial Sequence
  Description of Artificial Sequence: Synthetic light chain variable region CDR L2
aaggtttctaaccgggactct

SEQ ID NO: 1247 - protein, 9 aa, Artificial Sequence
  Description of Artificial Sequence: Synthetic light chain variable region CDR L3
MQGTQWPVT

SEQ ID NO: 1248 - DNA, 27 bp, Artificial Sequence
  Description of Artificial Sequence: Synthetic light chain variable region CDR L3
atgcaaggtacacagtggcctgtgaca

SEQ ID NO: 1249 - DNA, 354 bp, Artificial Sequence
  Description of Artificial Sequence: Synthetic heavy chain variable region
caggtccagctggtacagtctggggctgaggtgaagaagcctggggcctcagtgagggtctcctgcaaggtttacggtcacaccctcagtgaattatccatgcactgggtgcgacagggtcctgaaggaggccttgagtggatgggagcttttgatcatgaagatggtgaaggaatctacccacagaagttccagggcagaatcaccatgaccgcggacatatcgacagacacagcccacatggaactgaggagcctcagatctgaggacacggccgtttattactgtgcaacaccgaccccggttggagcaacggacttctggggccagggaaccctggtcaccgtctcctca

SEQ ID NO: 1250 - protein, 118 aa, Artificial Sequence
  Description of Artificial Sequence: Synthetic heavy chain variable region
QVQLVQSGAEVKKPGASVRVSCKVYGHTLSELSMHWVRQGPEGGLEWMGAFDHEDGEGIYPQKFQGRITMTADISTDTAHMELRSLRSEDTAVYYCATPTPVGATDFWGQGTLVTVSS

SEQ ID NO: 1251 - protein, 9 aa, Artificial Sequence
  Description of Artificial Sequence: Synthetic heavy chain variable region CDR H1
HTLSELSMH

SEQ ID NO: 1252 - DNA, 27 bp, Artificial Sequence
  Description of Artificial Sequence: Synthetic heavy chain variable region CDR H1
cacaccctcagtgaattatccatgcac

SEQ ID NO: 1253 - protein, 17 aa, Artificial Sequence
  Description of Artificial Sequence: Synthetic heavy chain variable region CDR H2
AFDHEDGEGIYPQKFQG

SEQ ID NO: 1254 - DNA, 51 bp, Artificial Sequence
  Description of Artificial Sequence: Synthetic heavy chain variable region CDR H2
gcttttgatcatgaagatggtgaaggaatctacccacagaagttccagggc

SEQ ID NO: 1255 - protein, 11 aa, Artificial Sequence
  Description of Artificial Sequence: Synthetic heavy chain variable region CDR H3
ATPTPVGATDF

SEQ ID NO: 1256 - DNA, 33 bp, Artificial Sequence
  Description of Artificial Sequence: Synthetic heavy chain variable region CDR H3
gcaacaccgaccccggttggagcaacggacttc

SEQ ID NO: 1257 - DNA, 321 bp, Artificial Sequence
  Description of Artificial Sequence: Synthetic light chain variable region
gacatccgggtgacccagtctccatcctccctgtctgcatctgtaggagacagagtcaccatcacttgccgggcaagtcagagcattagcagctacttaaattggtatcaacagaaaccaggaaaagcccctaagctcctgatctatgctgcatccactttgcagagggggggcccatcaagattcagtggcagtggatctgggacagatttcactctcagcatcagcagtctgcaacctgaagattttgcaacttactattgtcaacagacttacattattccatacacttttggccaggggaccaagctggagatcaaa

SEQ ID NO: 1258 - protein, 107 aa, Artificial Sequence
  Description of Artificial Sequence: Synthetic light chain variable region
DIRVTQSPSSLSASVGDRVTITCRASQSISSYLNWYQQKPGKAPKLLIYAASTLQRGGPSRFSGSGSGTDFTLSISSLQPEDFATYYCQQTYIIPYTFGQGTKLEIK

SEQ ID NO: 1259 - protein, 11 aa, Artificial Sequence
  Description of Artificial Sequence: Synthetic light chain variable region CDR L1
RASQSISSYLN

SEQ ID NO: 1260 - DNA, 33 bp, Artificial Sequence
  Description of Artificial Sequence: Synthetic light chain variable region CDR L1
cgggcaagtcagagcattagcagctacttaaat

SEQ ID NO: 1261 - protein, 7 aa, Artificial Sequence
  Description of Artificial Sequence: Synthetic light chain variable region CDR L2
AASTLQR

SEQ ID NO: 1262 - DNA, 21 bp, Artificial Sequence
  Description of Artificial Sequence: Synthetic light chain variable region CDR L2
gctgcatccactttgcagagg

SEQ ID NO: 1263 - protein, 9 aa, Artificial Sequence
  Description of Artificial Sequence: Synthetic light chain variable region CDR L3
QQTYIIPYT

SEQ ID NO: 1264 - DNA, 27 bp, Artificial Sequence
  Description of Artificial Sequence: Synthetic light chain variable region CDR L3
caacagacttacattattccatacact

SEQ ID NO: 1265 - DNA, 369 bp, Artificial Sequence
  Description of Artificial Sequence: Synthetic heavy chain variable region
caggtgcagctgcaggagtcgggcccgggactggtgaagccttcggagaccctgtccctcacctgcagtgtctctggtggctccatcaccaatgttaattactactggggctggatccgccagccccccgggaagggcctggagtggattgggagtatctattataatggaaacacctactacaacccgtccctccagagtcgagtcaccatgtccgtggacacgtccaagaaccacttctccctgaggctgacgtctgtgaccgccgcagacacggctgtatatttttgtgcgagagaggggcctaattgggaattgttgaatgctttcgatatctggggccaagggaccacggtcaccgtctcctca

SEQ ID NO: 1266 - protein, 123 aa, Artificial Sequence
  Description of Artificial Sequence: Synthetic heavy chain variable region
QVQLQESGPGLVKPSETLSLTCSVSGGSITNVNYYWGWIRQPPGKGLEWIGSIYYNGNTYYNPSLQSRVTMSVDTSKNHFSLRLTSVTAADTAVYFCAREGPNWELLNAFDIWGQGTTVTVSS

SEQ ID NO: 1267 - protein, 11 aa, Artificial Sequence
  Description of Artificial Sequence: Synthetic heavy chain variable region CDR H1
GSITNVNYYWG

SEQ ID NO: 1268 - DNA, 33 bp, Artificial Sequence
  Description of Artificial Sequence: Synthetic heavy chain variable region CDR H1
ggctccatcaccaatgttaattactactggggc

SEQ ID NO: 1269 - protein, 16 aa, Artificial Sequence
  Description of Artificial Sequence: Synthetic heavy chain variable region CDR H2
SIYYNGNTYYNPSLQS

SEQ ID NO: 1270 - DNA, 48 bp, Artificial Sequence
  Description of Artificial Sequence: Synthetic heavy chain variable region CDR H2
agtatctattataatggaaacacctactacaacccgtccctccagagt

SEQ ID NO: 1271 - protein, 15 aa, Artificial Sequence
  Description of Artificial Sequence: Synthetic heavy chain variable region CDR H3
AREGPNWELLNAFDI

SEQ ID NO: 1272 - DNA, 45 bp, Artificial Sequence
  Description of Artificial Sequence: Synthetic heavy chain variable region CDR H3
gcgagagaggggcctaattgggaattgttgaatgctttcgatatc

SEQ ID NO: 1273 - DNA, 324 bp, Artificial Sequence
  Description of Artificial Sequence: Synthetic light chain variable region
gacatccaggtgacccagccaccctcggtgtcagtggccccaggacagacggccaggattacctgtgggggaaacaacattggaagtaaaaatgtgcactggtaccagcagaagccaggccgggcccctgtcttggtcgtctatgaggatacccaccggccctcagggatccctgagcgattctctggctccaactctgggaacacggccaccctgaccatcagtagggtcgaagccggggatgaggccgactattactgtcaggtgtgggatactagtagtgatcatgtggtattcggcggagggaccaagctcaccgtccta

SEQ ID NO: 1274 - protein, 108 aa, Artificial Sequence
  Description of Artificial Sequence: Synthetic light chain variable region
DIQVTQPPSVSVAPGQTARITCGGNNIGSKNVHWYQQKPGRAPVLVVYEDTHRPSGIPERFSGSNSGNTATLTISRVEAGDEADYYCQVWDTSSDHVVFGGGTKLTVL

SEQ ID NO: 1275 - protein, 11 aa, Artificial Sequence
  Description of Artificial Sequence: Synthetic light chain variable region CDR L1
GGNNIGSKNVH

SEQ ID NO: 1276 - DNA, 33 bp, Artificial Sequence
  Description of Artificial Sequence: Synthetic light chain variable region CDR L1
gggggaaacaacattggaagtaaaaatgtgcac

SEQ ID NO: 1277 - protein, 7 aa, Artificial Sequence
  Description of Artificial Sequence: Synthetic light chain variable region CDR L2
EDTHRPS

SEQ ID NO: 1278 - DNA, 21 bp, Artificial Sequence
  Description of Artificial Sequence: Synthetic light chain variable region CDR L2
gaggatacccaccggccctca

SEQ ID NO: 1279 - protein, 11 aa, Artificial Sequence
  Description of Artificial Sequence: Synthetic light chain variable region CDR L3
QVWDTSSDHVV

SEQ ID NO: 1280 - DNA, 33 bp, Artificial Sequence
  Description of Artificial Sequence: Synthetic light chain variable region CDR L3
caggtgtgggatactagtagtgatcatgtggta

SEQ ID NO: 1281 - DNA, 363 bp, Artificial Sequence
  Description of Artificial Sequence: Synthetic heavy chain variable region
caggtccagctggtgcagtctgggggaggcctggtcaagcctgaggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagtctcaacagaattgggctactactacatggacgtctggggcaaagggaccacggtcactgtctcctca

SEQ ID NO: 1282 - protein, 121 aa, Artificial Sequence
  Description of Artificial Sequence: Synthetic heavy chain variable region
QVQLVQSGGGLVKPEGSLRLSCAASGFTFSSYSMNWVRQAPGKGLEWVSSISSSSSYIYYADSVKGRFTISRDNAKNSLYLQMNSLRAEDTAVYYCARVSTELGYYYMDVWGKGTTVTVSS

SEQ ID NO: 1283 - protein, 9 aa, Artificial Sequence
  Description of Artificial Sequence: Synthetic heavy chain variable region CDR H1
FTFSSYSMN

SEQ ID NO: 1284 - DNA, 27 bp, Artificial Sequence
  Description of Artificial Sequence: Synthetic heavy chain variable region CDR H1
ttcaccttcagtagctatagcatgaac

SEQ ID NO: 1285 - protein, 17 aa, Artificial Sequence
  Description of Artificial Sequence: Synthetic heavy chain variable region CDR H2
SISSSSSYIYYADSVKG

SEQ ID NO: 1286 - DNA, 51 bp, Artificial Sequence; identical to SEQ ID NO: 726
  Description of Artificial Sequence: Synthetic heavy chain variable region CDR H2

SEQ ID NO: 1287 - protein, 14 aa, Artificial Sequence
  Description of Artificial Sequence: Synthetic heavy chain variable region CDR H3
ARVSTELGYYYMDV

SEQ ID NO: 1288 - DNA, 42 bp, Artificial Sequence
  Description of Artificial Sequence: Synthetic heavy chain variable region CDR H3
gcgagagtctcaacagaattgggctactactacatggacgtc

SEQ ID NO: 1289 - DNA, 330 bp, Artificial Sequence
  Description of Artificial Sequence: Synthetic light chain variable region
cagtctgtcctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgtggtattcggcggagggaccaagctgaccgtccta

SEQ ID NO: 1290 - protein, 110 aa, Artificial Sequence
  Description of Artificial Sequence: Synthetic light chain variable region
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL

SEQ ID NO: 1291 - protein, 14 aa, Artificial Sequence
  Description of Artificial Sequence: Synthetic light chain variable region CDR L1
TGSSSNIGAGYDVH

SEQ ID NO: 1292 - DNA, 42 bp, Artificial Sequence; identical to SEQ ID NO: 572
  Description of Artificial Sequence: Synthetic light chain variable region CDR L1

SEQ ID NO: 1293 - protein, 7 aa, Artificial Sequence
  Description of Artificial Sequence: Synthetic light chain variable region CDR L2
GNSNRPS

SEQ ID NO: 1294 - DNA, 21 bp, Artificial Sequence
  Description of Artificial Sequence: Synthetic light chain variable region CDR L2
ggtaacagcaatcggccctca

SEQ ID NO: 1295 - protein, 10 aa, Artificial Sequence
  Description of Artificial Sequence: Synthetic light chain variable region CDR L3
QSYDSSLSVV

SEQ ID NO: 1296 - DNA, 30 bp, Artificial Sequence
  Description of Artificial Sequence: Synthetic light chain variable region CDR L3
cagtcctatgacagcagcctgagtgtggta

SEQ ID NO: 1297 - DNA, 360 bp, Artificial Sequence
  Description of Artificial Sequence: Synthetic heavy chain variable region
caggtccagcttgtacagtctggggctgaggtgaagaagcctggggcctcagtgaagatttcctgcaaggcttcgggataccccttcagttcctatcctatgcattgggtgcgccaggcccccggacaaaggcttgagtggatgggatggatcaacgttgacaatgagaacacaaaatattcatggaagttccggggcagagtcaccattaccagggacacatccgcgagcacagtttacatggagctgagcagtctgatatctgaagacacggctgtgtattactgtgggagagactgggacggggcgatccgtgtcttggactactggggccagggaaccctggtcaccgtctcctca

SEQ ID NO: 1298 - protein, 120 aa, Artificial Sequence
  Description of Artificial Sequence: Synthetic heavy chain variable region
QVQLVQSGAEVKKPGASVKISCKASGYPFSSYPMHWVRQAPGQRLEWMGWINVDNENTKYSWKFRGRVTITRDTSASTVYMELSSLISEDTAVYYCGRDWDGAIRVLDYWGQGTLVTVSS

SEQ ID NO: 1299 - protein, 9 aa, Artificial Sequence
  Description of Artificial Sequence: Synthetic heavy chain variable region CDR H1
YPFSSYPMH

SEQ ID NO: 1300 - DNA, 27 bp, Artificial Sequence
  Description of Artificial Sequence: Synthetic heavy chain variable region CDR H1
taccccttcagttcctatcctatgcat

SEQ ID NO: 1301 - protein, 17 aa, Artificial Sequence
  Description of Artificial Sequence: Synthetic heavy chain variable region CDR H2
WINVDNENTKYSWKFRG

SEQ ID NO: 1302 - DNA, 51 bp, Artificial Sequence
  Description of Artificial Sequence: Synthetic heavy chain variable region CDR H2
tggatcaacgttgacaatgagaacacaaaatattcatggaagttccggggc

SEQ ID NO: 1303 - protein, 13 aa, Artificial Sequence
  Description of Artificial Sequence: Synthetic heavy chain variable region CDR H3
GRDWDGAIRVLDY

SEQ ID NO: 1304 - DNA, 39 bp, Artificial Sequence
  Description of Artificial Sequence: Synthetic heavy chain variable region CDR H3
gggagagactgggacggggcgatccgtgtcttggactac

SEQ ID NO: 1305 - DNA, 339 bp, Artificial Sequence
  Description of Artificial Sequence: Synthetic light chain variable region
gatattgtgatgactcagactccagactccctggctgtgtctctgggcgagagggccaccatcacctgcaagtccagccagagtgttttattcagctccgacaataagaactacttagcttggtaccagcagaaaccgggacagcctcctaaattgctcatttactgggcatctatccgggaatccggggtccctgaccgattcggtggcagcgggtctgggacacatttcactctcaccatcaccagcgtgcaggctgcagatgtggcagtttattactgtcagcaatattatggtaatttccccaccttcggccaagggacacgactggagattaaa

SEQ ID NO: 1306 - protein, 113 aa, Artificial Sequence
  Description of Artificial Sequence: Synthetic light chain variable region
DIVMTQTPDSLAVSLGERATITCKSSQSVLFSSDNKNYLAWYQQKPGQPPKLLIYWASIRESGVPDRFGGSGSGTHFTLTITSVQAADVAVYYCQQYYGNFPTFGQGTRLEIK

SEQ ID NO: 1307 - protein, 17 aa, Artificial Sequence
  Description of Artificial Sequence: Synthetic light chain variable region CDR L1
KSSQSVLFSSDNKNYLA

SEQ ID NO: 1308 - DNA, 51 bp, Artificial Sequence
  Description of Artificial Sequence: Synthetic light chain variable region CDR L1
aagtccagccagagtgttttattcagctccgacaataagaactacttagct

SEQ ID NO: 1309 - protein, 7 aa, Artificial Sequence
  Description of Artificial Sequence: Synthetic light chain variable region CDR L2
WASIRES

SEQ ID NO: 1310 - DNA, 21 bp, Artificial Sequence
  Description of Artificial Sequence: Synthetic light chain variable region CDR L2
tgggcatctatccgggaatcc

SEQ ID NO: 1311 - protein, 9 aa, Artificial Sequence
  Description of Artificial Sequence: Synthetic light chain variable region CDR L3
QQYYGNFPT

SEQ ID NO: 1312 - DNA, 27 bp, Artificial Sequence
  Description of Artificial Sequence: Synthetic light chain variable region CDR L3
cagcaatattatggtaatttccccacc

SEQ ID NO: 1313 - DNA, 372 bp, Artificial Sequence
  Description of Artificial Sequence: Synthetic heavy chain variable region
caggtccagctggtgcagtctgggggaggcgtggtccagcctgggaggtccctgagactttcctgtgcagcctctggattcaccttcagaaactatggcatgcactgggtccgccaggctccaggcaaggggctggagtgggtagcggctgcatcgtatgatgggagtagtaagtactttgcagacgccgtgaagggccgattcagcatctccagagacaataccaagaacacgctgtctctgcaaatgaccagcctgagagctgaggacacggctgtgtattactgtgcaagagaccccggagtgggaagttattataacgtggtgggtatggacgtctggggccaagggaccacggtcaccgtctcctca

SEQ ID NO: 1314 - protein, 124 aa, Artificial Sequence
  Description of Artificial Sequence: Synthetic heavy chain variable region
QVQLVQSGGGVVQPGRSLRLSCAASGFTFRNYGMHWVRQAPGKGLEWVAAASYDGSSKYFADAVKGRFSISRDNTKNTLSLQMTSLRAEDTAVYYCARDPGVGSYYNVVGMDVWGQGTTVTVSS

SEQ ID NO: 1315 - protein, 9 aa, Artificial Sequence
  Description of Artificial Sequence: Synthetic heavy chain variable region CDR H1
FTFRNYGMH

SEQ ID NO: 1316 - DNA, 27 bp, Artificial Sequence
  Description of Artificial Sequence: Synthetic heavy chain variable region CDR H1
ttcaccttcagaaactatggcatgcac

SEQ ID NO: 1317 - protein, 17 aa, Artificial Sequence
  Description of Artificial Sequence: Synthetic heavy chain variable region CDR H2
AASYDGSSKYFADAVKG

SEQ ID NO: 1318 - DNA, 51 bp, Artificial Sequence
  Description of Artificial Sequence: Synthetic heavy chain variable region CDR H2
gctgcatcgtatgatgggagtagtaagtactttgcagacgccgtgaagggc

SEQ ID NO: 1319 - protein, 17 aa, Artificial Sequence
  Description of Artificial Sequence: Synthetic heavy chain variable region CDR H3
ARDPGVGSYYNVVGMDV

SEQ ID NO: 1320 - DNA, 51 bp, Artificial Sequence
  Description of Artificial Sequence: Synthetic heavy chain variable region CDR H3
gcaagagaccccggagtgggaagttattataacgtggtgggtatggacgtc

SEQ ID NO: 1321 - DNA, 336 bp, Artificial Sequence
  Description of Artificial Sequence: Synthetic light chain variable region
gacatccggttgacccagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttatagggtttctcaccgggactctggggtcccagacagattcagcggcagtgagtcaggcactgatttcacactgaaaatcagcagggtggaggctgaggatgttggcgtttattactgcatgcaaggtacacactggcctcctacgttcggccaagggaccaaggtggagatcaaa

SEQ ID NO: 1322 - protein, 112 aa, Artificial Sequence
  Description of Artificial Sequence: Synthetic light chain variable region
DIRLTQSPLSLPVTLGQPASISCRSSQSLVYSDGNTYLNWFQQRPGQSPRRLIYRVSHRDSGVPDRFSGSESGTDFTLKISRVEAEDVGVYYCMQGTHWPPTFGQGTKVEIK

SEQ ID NO: 1323 - protein, 16 aa, Artificial Sequence
  Description of Artificial Sequence: Synthetic light chain variable region CDR L1
RSSQSLVYSDGNTYLN

SEQ ID NO: 1324 - DNA, 48 bp, Artificial Sequence; identical to SEQ ID NO: 252
  Description of Artificial Sequence: Synthetic light chain variable region CDR L1

SEQ ID NO: 1325 - protein, 7 aa, Artificial Sequence
  Description of Artificial Sequence: Synthetic light chain variable region CDR L2
RVSHRDS

SEQ ID NO: 1326 - DNA, 21 bp, Artificial Sequence
  Description of Artificial Sequence: Synthetic light chain variable region CDR L2
agggtttctcaccgggactct

SEQ ID NO: 1327 - protein, 9 aa, Artificial Sequence
  Description of Artificial Sequence: Synthetic light chain variable region CDR L3
MQGTHWPPT

SEQ ID NO: 1328 - DNA, 27 bp, Artificial Sequence
  Description of Artificial Sequence: Synthetic light chain variable region CDR L3
atgcaaggtacacactggcctcctacg

SEQ ID NO: 1329 - DNA, 354 bp, Artificial Sequence
  Description of Artificial Sequence: Synthetic heavy chain variable region
caggtccagctggtgcagtctggggctgaggtgaagaagcctggggcctcagtgaaggtcgcctgcaaggtttccggatccagcctcactgaattgtccattcaatgggtgcgcttgcctcctggcaaacgccttgagtggctgggagcttttgatgctgaagatggtgcaccaatctactcaccgaaattccagggcagagtcaccatgaccgaggacagatcgacagagacagcctacatggaggtgaccagcctgagatctgaggacacggccctctattactgtgcgactccccttcccgcgggagcccttgacaagtggggccagggaaccctggtcaccgtctcctca

SEQ ID NO: 1330 - protein, 118 aa, Artificial Sequence
  Description of Artificial Sequence: Synthetic heavy chain variable region
QVQLVQSGAEVKKPGASVKVACKVSGSSLTELSIQWVRLPPGKRLEWLGAFDAEDGAPIYSPKFQGRVTMTEDRSTETAYMEVTSLRSEDTALYYCATPLPAGALDKWGQGTLVTVSS

SEQ ID NO: 1331 - protein, 9 aa, Artificial Sequence
  Description of Artificial Sequence: Synthetic heavy chain variable region CDR H1
SSLTELSIQ

SEQ ID NO: 1332 - DNA, 27 bp, Artificial Sequence
  Description of Artificial Sequence: Synthetic heavy chain variable region CDR H1
tccagcctcactgaattgtccattcaa

SEQ ID NO: 1333 - protein, 17 aa, Artificial Sequence
  Description of Artificial Sequence: Synthetic heavy chain variable region CDR H2
AFDAEDGAPIYSPKFQG

SEQ ID NO: 1334 - DNA, 51 bp, Artificial Sequence
  Description of Artificial Sequence: Synthetic heavy chain variable region CDR H2
gcttttgatgctgaagatggtgcaccaatctactcaccgaaattccagggc

SEQ ID NO: 1335 - protein, 11 aa, Artificial Sequence
  Description of Artificial Sequence: Synthetic heavy chain variable region CDR H3
ATPLPAGALDK

SEQ ID NO: 1336 - DNA, 33 bp, Artificial Sequence
  Description of Artificial Sequence: Synthetic heavy chain variable region CDR H3
gcgactccccttcccgcgggagcccttgacaag

SEQ ID NO: 1337 - DNA, 321 bp, Artificial Sequence
  Description of Artificial Sequence: Synthetic light chain variable region
gacatccagatgacccagtctccatcctccctgtctgcttccgtaggagacagagtcaccatctcttgccgggcaagtcagactataagcagatatttaaattggtatcaggtcaagccagggacagcccctaagctcctaatctacgctgcatccagtttgcaaactggggtcccatcaagattcagtgccagtggatctggggcagatttcactctcaccatcagcagtctgcaacctgaagattttgcgacttaccactgtcaacaaacttacattattccgtacacttttggccaggggaccaaagtggatatcaaa

SEQ ID NO: 1338 - protein, 107 aa, Artificial Sequence
  Description of Artificial Sequence: Synthetic light chain variable region
DIQMTQSPSSLSASVGDRVTISCRASQTISRYLNWYQVKPGTAPKLLIYAASSLQTGVPSRFSASGSGADFTLTISSLQPEDFATYHCQQTYIIPYTFGQGTKVDIK

SEQ ID NO: 1339 - protein, 11 aa, Artificial Sequence
  Description of Artificial Sequence: Synthetic light chain variable region CDR L1
RASQTISRYLN

SEQ ID NO: 1340 - DNA, 33 bp, Artificial Sequence
  Description of Artificial Sequence: Synthetic light chain variable region CDR L1
cgggcaagtcagactataagcagatatttaaat

SEQ ID NO: 1341 - protein, 7 aa, Artificial Sequence
  Description of Artificial Sequence: Synthetic light chain variable region CDR L2
AASSLQT

SEQ ID NO: 1342 - DNA, 21 bp, Artificial Sequence
  Description of Artificial Sequence: Synthetic light chain variable region CDR L2
gctgcatccagtttgcaaact

SEQ ID NO: 1343 - protein, 9 aa, Artificial Sequence
  Description of Artificial Sequence: Synthetic light chain variable region CDR L3
QQTYIIPYT

SEQ ID NO: 1344 - DNA, 27 bp, Artificial Sequence
  Description of Artificial Sequence: Synthetic light chain variable region CDR L3
caacaaacttacattattccgtacact

SEQ ID NO: 1345 - DNA, 381 bp, Artificial Sequence
  Description of Artificial Sequence: Synthetic heavy chain variable region
gaggtgcagctggtggagtcgggcccaggactggtgaagccttcacagaccctgtccctcacctgcactgtctctgatgtcctcatcagcagtggtgattactactggagttggatccgccagtccccagggaagggcctggagtggcttgggtacatctattataccgggaagaccaaatataatccgtccctcgagagtcgaattaccatgtcagtagacacgtccaagaaccagttctccctgaggttgagctctgttactgccgcagacacggccgtatatttctgtaccagagatctgggatatagcacctcgtccccctccttttactatgggatggacgtctggggccaagggaccacggtcaccgtctcctca

SEQ ID NO: 1346 - protein, 127 aa, Artificial Sequence
  Description of Artificial Sequence: Synthetic heavy chain variable region
EVQLVESGPGLVKPSQTLSLTCTVSDVLISSGDYYWSWIRQSPGKGLEWLGYIYYTGKTKYNPSLESRITMSVDTSKNQFSLRLSSVTAADTAVYFCTRDLGYSTSSPSFYYGMDVWGQGTTVTVSS

SEQ ID NO: 1347 - protein, 11 aa, Artificial Sequence
  Description of Artificial Sequence: Synthetic heavy chain variable region CDR H1
VLISSGDYYWS

SEQ ID NO: 1348 - DNA, 33 bp, Artificial Sequence
  Description of Artificial Sequence: Synthetic heavy chain variable region CDR H1
gtcctcatcagcagtggtgattactactggagt

SEQ ID NO: 1349 - protein, 16 aa, Artificial Sequence
  Description of Artificial Sequence: Synthetic heavy chain variable region CDR H2
YIYYTGKTKYNPSLES

SEQ ID NO: 1350 - DNA, 48 bp, Artificial Sequence
  Description of Artificial Sequence: Synthetic heavy chain variable region CDR H2
tacatctattataccgggaagaccaaatataatccgtccctcgagagt

SEQ ID NO: 1351 - protein, 19 aa, Artificial Sequence
  Description of Artificial Sequence: Synthetic heavy chain variable region CDR H3
TRDLGYSTSSPSFYYGMDV

SEQ ID NO: 1352 - DNA, 57 bp, Artificial Sequence
  Description of Artificial Sequence: Synthetic heavy chain variable region CDR H3
accagagatctgggatatagcacctcgtccccctccttttactatgggatggacgtc

SEQ ID NO: 1353 - DNA, 321 bp, Artificial Sequence
  Description of Artificial Sequence: Synthetic light chain variable region
gaaattgtgttgacacagtctccagccaccctgtctttgtctccaggggaaagagccaccctctcctgcagggccagtcagagtgttgggacctacttagcctggtaccaacagaaacctggccaggctcccaggctcctcatctatgatgcatcttacagggtcactggcatcccagccaggttcagtgccagtgggtctgcgacagacttcactctcaccatcagcagcctagagcctgaagattttgcagtttatttctgtcagcagcgtaccaactggccgatcaccttcggccaggggacacgactggagattaaa

SEQ ID NO: 1354 - protein, 107 aa, Artificial Sequence
  Description of Artificial Sequence: Synthetic light chain variable region
EIVLTQSPATLSLSPGERATLSCRASQSVGTYLAWYQQKPGQAPRLLIYDASYRVTGIPARFSASGSATDFTLTISSLEPEDFAVYFCQQRTNWPITFGQGTRLEIK

SEQ ID NO: 1355 - protein, 11 aa, Artificial Sequence
  Description of Artificial Sequence: Synthetic light chain variable region CDR L1
RASQSVGTYLA

SEQ ID NO: 1356 - DNA, 33 bp, Artificial Sequence
  Description of Artificial Sequence: Synthetic light chain variable region CDR L1
agggccagtcagagtgttgggacctacttagcc

SEQ ID NO: 1357 - protein, 7 aa, Artificial Sequence
  Description of Artificial Sequence: Synthetic light chain variable region CDR L2
DASYRVT

SEQ ID NO: 1358 - DNA, 21 bp, Artificial Sequence
  Description of Artificial Sequence: Synthetic light chain variable region CDR L2
gatgcatcttacagggtcact

SEQ ID NO: 1359 - protein, 9 aa, Artificial Sequence
  Description of Artificial Sequence: Synthetic light chain variable region CDR L3
QQRTNWPIT

SEQ ID NO: 1360 - DNA, 27 bp, Artificial Sequence
  Description of Artificial Sequence: Synthetic light chain variable region CDR L3
cagcagcgtaccaactggccgatcacc

SEQ ID NO: 1361 - DNA, 366 bp, Artificial Sequence
  Description of Artificial Sequence: Synthetic heavy chain variable region
caggtccagcttgtgcagtctggacctgaggtgaagaagcctggggcctcagtgacggtctcctgcaaggcttccggttacacctttagccattacggtattagttgggtgcgacaggcccctggacaagggcttgagtggatggggtggatcagcgcgtaccatggtcagacaaactatgcacagaacttccagggcagagtcaccatgaccacagacacatcctcgaacacagcctacatggaggtcaggagcctgagatctgacgacacggccgtttatttctgtgcgagagatgtcttttcgaaaacagcagctcgaatctttgactactggggccagggaaccctggtcaccgtctcctca

SEQ ID NO: 1362 - protein, 122 aa, Artificial Sequence
  Description of Artificial Sequence: Synthetic heavy chain variable region
QVQLVQSGPEVKKPGASVTVSCKASGYTFSHYGISWVRQAPGQGLEWMGWISAYHGQTNYAQNFQGRVTMTTDTSSNTAYMEVRSLRSDDTAVYFCARDVFSKTAARIFDYWGQGTLVTVSS

SEQ ID NO: 1363 - protein, 9 aa, Artificial Sequence
  Description of Artificial Sequence: Synthetic heavy chain variable region CDR H1
YTFSHYGIS

SEQ ID NO: 1364 - DNA, 27 bp, Artificial Sequence
  Description of Artificial Sequence: Synthetic heavy chain variable region CDR H1
tacacctttagccattacggtattagt

SEQ ID NO: 1365 - protein, 17 aa, Artificial Sequence
  Description of Artificial Sequence: Synthetic heavy chain variable region CDR H2
WISAYHGQTNYAQNFQG

SEQ ID NO: 1366 - DNA, 51 bp, Artificial Sequence
  Description of Artificial Sequence: Synthetic heavy chain variable region CDR H2
tggatcagcgcgtaccatggtcagacaaactatgcacagaacttccagggc

SEQ ID NO: 1367 - protein, 15 aa, Artificial Sequence
  Description of Artificial Sequence: Synthetic heavy chain variable region CDR H3
ARDVFSKTAARIFDY

SEQ ID NO: 1368 - DNA, 45 bp, Artificial Sequence
  Description of Artificial Sequence: Synthetic heavy chain variable region CDR H3
gcgagagatgtcttttcgaaaacagcagctcgaatctttgactac

SEQ ID NO: 1369 - DNA, 336 bp, Artificial Sequence
  Description of Artificial Sequence: Synthetic light chain variable region
gaaattgtattgacgcagtctccactctccctgcccgtcacccttggacagccggcctccatctcctgcaggtctagtcaaagcctcgaatatagtgacggaaacacctacttgagttggtttcagcagaggccaggccaatctccaaggcgcctaatttataaggtttctaaccgggactctggggtcccagacagattcagcggcagtcagtcaggcactgatttcacactgaaaatcagcagggtggaggctgaggatgttggggtttattactgcatgcaagctacagactggccggtcacgttcggccaagggaccaagctggagatcaaa

SEQ ID NO: 1370 - protein, 112 aa, Artificial Sequence
  Description of Artificial Sequence: Synthetic light chain variable region
EIVLTQSPLSLPVTLGQPASISCRSSQSLEYSDGNTYLSWFQQRPGQSPRRLIYKVSNRDSGVPDRFSGSQSGTDFTLKISRVEAEDVGVYYCMQATDWPVTFGQGTKLEIK

SEQ ID NO: 1371 - protein, 16 aa, Artificial Sequence
  Description of Artificial Sequence: Synthetic light chain variable region CDR L1
RSSQSLEYSDGNTYLS

SEQ ID NO: 1372 - DNA, 48 bp, Artificial Sequence
  Description of Artificial Sequence: Synthetic light chain variable region CDR L1
aggtctagtcaaagcctcgaatatagtgacggaaacacctacttgagt

SEQ ID NO: 1373 - protein, 7 aa, Artificial Sequence
  Description of Artificial Sequence: Synthetic light chain variable region CDR L2
KVSNRDS

SEQ ID NO: 1374 - DNA, 21 bp, Artificial Sequence
  Description of Artificial Sequence: Synthetic light chain variable region CDR L2
aaggtttctaaccgggactct

SEQ ID NO: 1375 - protein, 9 aa, Artificial Sequence
  Description of Artificial Sequence: Synthetic light chain variable region CDR L3
MQATDWPVT

SEQ ID NO: 1376 - DNA, 27 bp, Artificial Sequence
  Description of Artificial Sequence: Synthetic light chain variable region CDR L3
atgcaagctacagactggccggtcacg

SEQ ID NO: 1377 - DNA, 384 bp, Artificial Sequence
  Description of Artificial Sequence: Synthetic heavy chain variable region
caggtgcagctgcaggagtcgggcccaagactggtgaagccttcgcagaccctgtccctcacctgcactgtctctggtggctccatcagcagtggtgattattactggagttggatccgccagcccccagggaagggcctggagtggattgggtacatctattacagtgggagcacccactacaacccgtccctcaagagtcgagttagcatgtcagtagacacggccaagaaccagttctccctgaagctgacctctgtgactgccgcagacacggccgtctattactgtgccagagatatcggctacggtgaccacgggactgggtcttattactacggaatagaagactggggccaagggaccacggtcaccgtctcctca

SEQ ID NO: 1378 - protein, 128 aa, Artificial Sequence
  Description of Artificial Sequence: Synthetic heavy chain variable region
QVQLQESGPRLVKPSQTLSLTCTVSGGSISSGDYYWSWIRQPPGKGLEWIGYIYYSGSTHYNPSLKSRVSMSVDTAKNQFSLKLTSVTAADTAVYYCARDIGYGDHGTGSYYYGIEDWGQGTTVTVSS

SEQ ID NO: 1379 - protein, 11 aa, Artificial Sequence
  Description of Artificial Sequence: Synthetic heavy chain variable region CDR H1
GSISSGDYYWS

SEQ ID NO: 1380 - DNA, 33 bp, Artificial Sequence
  Description of Artificial Sequence: Synthetic heavy chain variable region CDR H1
ggctccatcagcagtggtgattattactggagt

SEQ ID NO: 1381 - protein, 16 aa, Artificial Sequence
  Description of Artificial Sequence: Synthetic heavy chain variable region CDR H2
YIYYSGSTHYNPSLKS

SEQ ID NO: 1382 - DNA, 48 bp, Artificial Sequence
  Description of Artificial Sequence: Synthetic heavy chain variable region CDR H2
tacatctattacagtgggagcacccactacaacccgtccctcaagagt

SEQ ID NO: 1383 - protein, 20 aa, Artificial Sequence
  Description of Artificial Sequence: Synthetic heavy chain variable region CDR H3
ARDIGYGDHGTGSYYYGIED

SEQ ID NO: 1384 - DNA, 60 bp, Artificial Sequence
  Description of Artificial Sequence: Synthetic heavy chain variable region CDR H3
gccagagatatcggctacggtgaccacgggactgggtcttattactacggaatagaagac

SEQ ID NO: 1385 - DNA, 318 bp, Artificial Sequence
  Description of Artificial Sequence: Synthetic light chain variable region
gatattgtgatgactcagactccagccaccctgtctttgtctccaggggacagagccaccctctcctgcagggccagtcagaatattatgagctacttagcctggtaccaacacaaacctggccagcctcccaggctcctcatctatgatgcatcctacagggccgctggcatcccagccaggttcagtggcagtgggtctgggacagacttcactctcaccatcagcagcctagagcctgaagattttgcagtttattactgtcagcagcgaaccaactggatcaccttcggccaagggacacgactggagattaaa

SEQ ID NO: 1386 - protein, 106 aa, Artificial Sequence
  Description of Artificial Sequence: Synthetic light chain variable region
DIVMTQTPATLSLSPGDRATLSCRASQNIMSYLAWYQHKPGQPPRLLIYDASYRAAGIPARFSGSGSGTDFTLTISSLEPEDFAVYYCQQRTNWITFGQGTRLEIK

SEQ ID NO: 1387 - protein, 11 aa, Artificial Sequence
  Description of Artificial Sequence: Synthetic light chain variable region CDR L1
RASQNIMSYLA

SEQ ID NO: 1388 - DNA, 33 bp, Artificial Sequence
  Description of Artificial Sequence: Synthetic light chain variable region CDR L1
agggccagtcagaatattatgagctacttagcc

SEQ ID NO: 1389 - protein, 7 aa, Artificial Sequence
  Description of Artificial Sequence: Synthetic light chain variable region CDR L2
DASYRAA

SEQ ID NO: 1390 - DNA, 21 bp, Artificial Sequence
  Description of Artificial Sequence: Synthetic light chain variable region CDR L2
gatgcatcctacagggccgct

SEQ ID NO: 1391 - protein, 8 aa, Artificial Sequence
  Description of Artificial Sequence: Synthetic light chain variable region CDR L3
QQRTNWIT

SEQ ID NO: 1392 - DNA, 24 bp, Artificial Sequence
  Description of Artificial Sequence: Synthetic light chain variable region CDR L3
cagcagcgaaccaactggatcacc

SEQ ID NO: 1393 - DNA, 369 bp, Artificial Sequence
  Description of Artificial Sequence: Synthetic heavy chain variable region
gaggtgcagctggtggagtcagggggaggcttggtgcagcggggggggtccctgagactctcgtgtgcggcctctggattcacctttagtggtaatgccatgagctgggtccgccaggctccagggaaggggctggagtgggtcgcatctattggtgaaagtgctactagcgcatactacgcagactccgtgaagggccggttcaccatctccagagatgattcgaagaacactctgtatctccaaatgaacagcctgagacccgaggacacggccgtatatttctgtgcgaaagatcgcgtaggatggttcggggagttcgacgcttttgatttctggggccaagggacaatggtcaccgtctcttca

SEQ ID NO: 1394 - protein, 123 aa, Artificial Sequence
  Description of Artificial Sequence: Synthetic heavy chain variable region
EVQLVESGGGLVQRGGSLRLSCAASGFTFSGNAMSWVRQAPGKGLEWVASIGESATSAYYADSVKGRFTISRDDSKNTLYLQMNSLRPEDTAVYFCAKDRVGWFGEFDAFDFWGQGTMVTVSS

SEQ ID NO: 1395 - protein, 9 aa, Artificial Sequence
  Description of Artificial Sequence: Synthetic heavy chain variable region CDR H1
FTFSGNAMS

SEQ ID NO: 1396 - DNA, 27 bp, Artificial Sequence
  Description of Artificial Sequence: Synthetic heavy chain variable region CDR H1
ttcacctttagtggtaatgccatgagc

SEQ ID NO: 1397 - protein, 17 aa, Artificial Sequence
  Description of Artificial Sequence: Synthetic heavy chain variable region CDR H2
SIGESATSAYYADSVKG

SEQ ID NO: 1398 - DNA, 51 bp, Artificial Sequence
  Description of Artificial Sequence: Synthetic heavy chain variable region CDR H2
tctattggtgaaagtgctactagcgcatactacgcagactccgtgaagggc

SEQ ID NO: 1399 - protein, 16 aa, Artificial Sequence
  Description of Artificial Sequence: Synthetic heavy chain variable region CDR H3
AKDRVGWFGEFDAFDF

SEQ ID NO: 1400 - DNA, 48 bp, Artificial Sequence
  Description of Artificial Sequence: Synthetic heavy chain variable region CDR H3
gcgaaagatcgcgtaggatggttcggggagttcgacgcttttgatttc

SEQ ID NO: 1401 - DNA, 324 bp, Artificial Sequence
  Description of Artificial Sequence: Synthetic light chain variable region
tcctatgagctgacgcagccaccctcagtgtcagtggccccaggaaagacggccaccatttcctgtgggggaaacaacattggaggtcacaaagtgcactggtaccagcagaggccaggccaggcccctgtcttggtcatctattatgataacgtccggccctcagggatccctgagcgattctctggctccaactctggaaacacggccaccctgaccatcagcagggtcgaggccggggatgaggccgacttttactgtcaggtgtgggatagtcgttctgaacatgtcatattcggcggggggaccaaggtcaccgtccta

SEQ ID NO: 1402 - protein, 108 aa, Artificial Sequence
  Description of Artificial Sequence: Synthetic light chain variable region
SYELTQPPSVSVAPGKTATISCGGNNIGGHKVHWYQQRPGQAPVLVIYYDNVRPSGIPERFSGSNSGNTATLTISRVEAGDEADFYCQVWDSRSEHVIFGGGTKVTVL

SEQ ID NO: 1403 - protein, 11 aa, Artificial Sequence
  Description of Artificial Sequence: Synthetic light chain variable region CDR L1
GGNNIGGHKVH

SEQ ID NO: 1404 - DNA, 33 bp, Artificial Sequence
  Description of Artificial Sequence: Synthetic light chain variable region CDR L1
gggggaaacaacattggaggtcacaaagtgcac

SEQ ID NO: 1405 - protein, 7 aa, Artificial Sequence
  Description of Artificial Sequence: Synthetic light chain variable region CDR L2
YDNVRPS

SEQ ID NO: 1406 - DNA, 21 bp, Artificial Sequence
  Description of Artificial Sequence: Synthetic light chain variable region CDR L2
tatgataacgtccggccctca

SEQ ID NO: 1407 - protein, 11 aa, Artificial Sequence
  Description of Artificial Sequence: Synthetic light chain variable region CDR L3
QVWDSRSEHVI

SEQ ID NO: 1408 - DNA, 33 bp, Artificial Sequence
  Description of Artificial Sequence: Synthetic light chain variable region CDR L3
caggtgtgggatagtcgttctgaacatgtcata

SEQ ID NO: 1409 - DNA, 363 bp, Artificial Sequence
  Description of Artificial Sequence: Synthetic heavy chain variable region
caggtccagcttgtacagtctggagctgaggtgaagaagcctggggcctcagtgaaggtctcgtgcaagacttctggttacaccttttccaactacggtatcagctggctgcgacaggcccctggacaagggcttgagtggatggcatggatcagcccttataatgggaacacaaagtctgcacagaggtttcagggcagagtcatcatgaccacagacacatccacgaggacagcccacatggaggtgaagagcctgagaactgacgacacggccacatattactgtgcgagagatccagcagtcgatgcaataccgatgcttgactactggggccagggaaccctggtcaccgtctcctca

SEQ ID NO: 1410 - protein, 121 aa, Artificial Sequence
  Description of Artificial Sequence: Synthetic heavy chain variable region
QVQLVQSGAEVKKPGASVKVSCKTSGYTFSNYGISWLRQAPGQGLEWMAWISPYNGNTKSAQRFQGRVIMTTDTSTRTAHMEVKSLRTDDTATYYCARDPAVDAIPMLDYWGQGTLVTVSS

SEQ ID NO: 1411 - protein, 9 aa, Artificial Sequence
  Description of Artificial Sequence: Synthetic heavy chain variable region CDR H1
YTFSNYGIS

SEQ ID NO: 1412 - DNA, 27 bp, Artificial Sequence
  Description of Artificial Sequence: Synthetic heavy chain variable region CDR H1
tacaccttttccaactacggtatcagc

SEQ ID NO: 1413 - protein, 17 aa, Artificial Sequence
  Description of Artificial Sequence: Synthetic heavy chain variable region CDR H2
WISPYNGNTKSAQRFQG

SEQ ID NO: 1414 - DNA, 51 bp, Artificial Sequence; identical to SEQ ID NO: 1046
  Description of Artificial Sequence: Synthetic heavy chain variable region CDR H2

SEQ ID NO: 1415 - protein, 14 aa, Artificial Sequence
  Description of Artificial Sequence: Synthetic heavy chain variable region CDR H3
ARDPAVDAIPMLDY

SEQ ID NO: 1416 - DNA, 42 bp, Artificial Sequence; identical to SEQ ID NO: 1048
  Description of Artificial Sequence: Synthetic heavy chain variable region CDR H3

SEQ ID NO: 1417 - DNA, 336 bp, Artificial Sequence
  Description of Artificial Sequence: Synthetic light chain variable region
gacatccagatgacccagtctccactctccctgcccgtcacccttggacagccggcctccatctcctgcaggtctagtcaaagcctcgtgtacactgatggaaacacctacttgagctggtttcagcagaggccaggccaatctccaaggcgcctaatttatagggtttctcaccgggactctggggtcccagacagattcaccggcagtgggtcaggcactgatttcacactgataatccgcagggtggaggctgaggatgttggggtttattactgcatgcaaggtacacactggcctctcactttcggcggagggaccaagctggagatcaaa

SEQ ID NO: 1418 - protein, 112 aa, Artificial Sequence
  Description of Artificial Sequence: Synthetic light chain variable region
DIQMTQSPLSLPVTLGQPASISCRSSQSLVYTDGNTYLSWFQQRPGQSPRRLIYRVSHRDSGVPDRFTGSGSGTDFTLIIRRVEAEDVGVYYCMQGTHWPLTFGGGTKLEIK

SEQ ID NO: 1419 - protein, 16 aa, Artificial Sequence
  Description of Artificial Sequence: Synthetic light chain variable region CDR L1
RSSQSLVYTDGNTYLS

SEQ ID NO: 1420 - DNA, 48 bp, Artificial Sequence; identical to SEQ ID NO: 1052
  Description of Artificial Sequence: Synthetic light chain variable region CDR L1

SEQ ID NO: 1421 - protein, 7 aa, Artificial Sequence
  Description of Artificial Sequence: Synthetic light chain variable region CDR L2
RVSHRDS

SEQ ID NO: 1422 - DNA, 21 bp, Artificial Sequence
  Description of Artificial Sequence: Synthetic light chain variable region CDR L2
agggtttctcaccgggactct

SEQ ID NO: 1423 - protein, 9 aa, Artificial Sequence
  Description of Artificial Sequence: Synthetic light chain variable region CDR L3
MQGTHWPLT

SEQ ID NO: 1424 - DNA, 27 bp, Artificial Sequence
  Description of Artificial Sequence: Synthetic light chain variable region CDR L3
atgcaaggtacacactggcctctcact

SEQ ID NO: 1425 - DNA, 378 bp, Artificial Sequence
  Description of Artificial Sequence: Synthetic heavy chain variable region
caggtccagctggtacagtctggtcctgcgctggtgaaacccacacagaccctcacactgacctgcaccttcggtggattctcactcagcagacatggaatgcgtgtgacctggatccgtcaggcccccgggaaggccctggagtggcttggtcacattgattgggatgatgataaattctacaggacatctctgaagaccaggctcaccatctccaaggacccctctaacaatgaggtggtcctgaaaatgaccaacatggaccacgtggacacagccacgtattactgtgcactgatgaggcccttttggagtcgtgacgactactactattccatcgccgtctggggcaaagggaccacggtcaccgtctcctca

SEQ ID NO: 1426 - protein, 126 aa, Artificial Sequence
  Description of Artificial Sequence: Synthetic heavy chain variable region
QVQLVQSGPALVKPTQTLTLTCTFGGFSLSRHGMRVTWIRQAPGKALEWLGHIDWDDDKFYRTSLKTRLTISKDPSNNEVVLKMTNMDHVDTATYYCALMRPFWSRDDYYYSIAVWGKGTTVTVSS

SEQ ID NO: 1427 - protein, 11 aa, Artificial Sequence
  Description of Artificial Sequence: Synthetic heavy chain variable region CDR H1
FSLSRHGMRVT

SEQ ID NO: 1428 - DNA, 33 bp, Artificial Sequence
  Description of Artificial Sequence: Synthetic heavy chain variable region CDR H1
ttctcactcagcagacatggaatgcgtgtgacc

SEQ ID NO: 1429 - protein, 16 aa, Artificial Sequence
  Description of Artificial Sequence: Synthetic heavy chain variable region CDR H2
HIDWDDDKFYRTSLKT

SEQ ID NO: 1430 - DNA, 48 bp, Artificial Sequence
  Description of Artificial Sequence: Synthetic heavy chain variable region CDR H2
cacattgattgggatgatgataaattctacaggacatctctgaagacc

SEQ ID NO: 1431 - protein, 18 aa, Artificial Sequence
  Description of Artificial Sequence: Synthetic heavy chain variable region CDR H3
ALMRPFWSRDDYYYSIAV

SEQ ID NO: 1432 - DNA, 54 bp, Artificial Sequence
  Description of Artificial Sequence: Synthetic heavy chain variable region CDR H3
gcactgatgaggcccttttggagtcgtgacgactactactattccatcgccgtc

SEQ ID NO: 1433 - DNA, 345 bp, Artificial Sequence
  Description of Artificial Sequence: Synthetic light chain variable region
gatattgtgctgacccagtctccaggcaccctgtctttgtctccaggggacagagccaccctctcctgcagggccagtcagagtgtcggcagcggctacgtaacctggtaccagcagaaacctggccaggctcccaggctcctcatttatggtgcatcaaacagggccgaaggcatcccagacaggttcagtggcagtgggtctgggacagacttcactctcaccatcagcggactggagtctgaagattttgtaatttattactgtcagctatatcataggtcacctggctctgcgagtcaaaccgtttggacgttcggccaagggaccaaggtggaaatcaaa

SEQ ID NO: 1434 - protein, 115 aa, Artificial Sequence
  Description of Artificial Sequence: Synthetic light chain variable region
DIVLTQSPGTLSLSPGDRATLSCRASQSVGSGYVTWYQQKPGQAPRLLIYGASNRAEGIPDRFSGSGSGTDFTLTISGLESEDFVIYYCQLYHRSPGSASQTVWTFGQGTKVEIK

SEQ ID NO: 1435 - protein, 12 aa, Artificial Sequence
  Description of Artificial Sequence: Synthetic light chain variable region CDR L1
RASQSVGSGYVT

SEQ ID NO: 1436 - DNA, 36 bp, Artificial Sequence
  Description of Artificial Sequence: Synthetic light chain variable region CDR L1
agggccagtcagagtgtcggcagcggctacgtaacc

SEQ ID NO: 1437 - protein, 7 aa, Artificial Sequence
  Description of Artificial Sequence: Synthetic light chain variable region CDR L2
GASNRAE

SEQ ID NO: 1438 - DNA, 21 bp, Artificial Sequence
  Description of Artificial Sequence: Synthetic light chain variable region CDR L2
ggtgcatcaaacagggccgaa

SEQ ID NO: 1439 - protein, 16 aa, Artificial Sequence
  Description of Artificial Sequence: Synthetic light chain variable region CDR L3
QLYHRSPGSASQTVWT

SEQ ID NO: 1440 - DNA, 48 bp, Artificial Sequence
  Description of Artificial Sequence: Synthetic light chain variable region CDR L3
cagctatatcataggtcacctggctctgcgagtcaaaccgtttggacg

SEQ ID NO: 1441 - DNA, 363 bp, Artificial Sequence
  Description of Artificial Sequence: Synthetic heavy chain variable region
caggtccagcttgtacagtctggacctgaggtgaagaagcctggggcctcagtgagggtctcctgcgaggcttctggttacccctttagcaattacggcatcacctgggtgcgccaggcccctggacaagggcttgagtggatgggatggatcagcgcttacaacggaaacagagactatctgcagaagtttcagggcagactcaccatgaccatagacacatccacgagaacagcccacatggaattgaggcgcctgacatctgacgacacggccgtatattggtgtgcgagagacacacccgccactgctgcccctctgcttgactactggggccagggaaccctggtcaccgtctcctca

SEQ ID NO: 1442 - protein, 121 aa, Artificial Sequence
  Description of Artificial Sequence: Synthetic heavy chain variable region
QVQLVQSGPEVKKPGASVRVSCEASGYPFSNYGITWVRQAPGQGLEWMGWISAYNGNRDYLQKFQGRLTMTIDTSTRTAHMELRRLTSDDTAVYWCARDTPATAAPLLDYWGQGTLVTVSS

SEQ ID NO: 1443 - protein, 9 aa, Artificial Sequence
  Description of Artificial Sequence: Synthetic heavy chain variable region CDR H1
YPFSNYGIT

SEQ ID NO: 1444 - DNA, 27 bp, Artificial Sequence
  Description of Artificial Sequence: Synthetic heavy chain variable region CDR H1
tacccctttagcaattacggcatcacc

SEQ ID NO: 1445 - protein, 17 aa, Artificial Sequence
  Description of Artificial Sequence: Synthetic heavy chain variable region CDR H2
WISAYNGNRDYLQKFQG

SEQ ID NO: 1446 - DNA, 51 bp, Artificial Sequence
  Description of Artificial Sequence: Synthetic heavy chain variable region CDR H2
tggatcagcgcttacaacggaaacagagactatctgcagaagtttcagggc

SEQ ID NO: 1447 - protein, 14 aa, Artificial Sequence
  Description of Artificial Sequence: Synthetic heavy chain variable region CDR H3
ARDTPATAAPLLDY

SEQ ID NO: 1448 - DNA, 42 bp, Artificial Sequence
  Description of Artificial Sequence: Synthetic heavy chain variable region CDR H3
gcgagagacacacccgccactgctgcccctctgcttgactac

SEQ ID NO: 1449 - DNA, 336 bp, Artificial Sequence
  Description of Artificial Sequence: Synthetic light chain variable region
gatattgtgatgactcagtctccactctccctggccgtcacccttggacagccggcctccatctcctgcaggtctagtcaaagcctcgaattcactgatggaaacacctacttgaattggtttcagcagaggccaggccaatctccaaggcgcctaatttataaggtttctaaccgggactctggggtcccagacagattcagcggcagtgggtcaggcactggtttcacactgaaaatcagcagggtggaggctgaggatgttggggtttattactgcatgcaaggtattttccggccggggacgttcggccaagggaccaaggtggaaatcaaa

SEQ ID NO: 1450 - protein, 112 aa, Artificial Sequence
  Description of Artificial Sequence: Synthetic light chain variable region
DIVMTQSPLSLAVTLGQPASISCRSSQSLEFTDGNTYLNWFQQRPGQSPRRLIYKVSNRDSGVPDRFSGSGSGTGFTLKISRVEAEDVGVYYCMQGIFRPGTFGQGTKVEIK

SEQ ID NO: 1451 - protein, 16 aa, Artificial Sequence
  Description of Artificial Sequence: Synthetic light chain variable region CDR L1
RSSQSLEFTDGNTYLN

SEQ ID NO: 1452 - DNA, 48 bp, Artificial Sequence
  Description of Artificial Sequence: Synthetic light chain variable region CDR L1
aggtctagtcaaagcctcgaattcactgatggaaacacctacttgaat

SEQ ID NO: 1453 - protein, 7 aa, Artificial Sequence
  Description of Artificial Sequence: Synthetic light chain variable region CDR L2
KVSNRDS

SEQ ID NO: 1454 - DNA, 21 bp, Artificial Sequence
  Description of Artificial Sequence: Synthetic light chain variable region CDR L2
aaggtttctaaccgggactct

SEQ ID NO: 1455 - protein, 9 aa, Artificial Sequence
  Description of Artificial Sequence: Synthetic light chain variable region CDR L3
MQGIFRPGT

SEQ ID NO: 1456 - DNA, 27 bp, Artificial Sequence
  Description of Artificial Sequence: Synthetic light chain variable region CDR L3
atgcaaggtattttccggccggggacg

SEQ ID NO: 1457 - DNA, 363 bp, Artificial Sequence
  Description of Artificial Sequence: Synthetic heavy chain variable region
caggtccagctggtgcagtctggagctgaggtgaagaagcctggggcctcagtgaaggtctcctgcaaggcttctggttacacctttgtccactatggtatcagttgggtgcgacaggcccctggacaagggcttgagtggatgggatggatcagcgcatacaatggtaatacaaactctgcactgaagttccaggacagagtcaccatgaccacagacccatccacgagcacagcctacatggagctgaggagcctgagatctgacgacacggccatttattactgtgcgagagactcaggttgttgtagtggttccacctcagacgtctggggcaaagggaccacggtcaccgtctcctca

SEQ ID NO: 1458 - protein, 121 aa, Artificial Sequence
  Description of Artificial Sequence: Synthetic heavy chain variable region
QVQLVQSGAEVKKPGASVKVSCKASGYTFVHYGISWVRQAPGQGLEWMGWISAYNGNTNSALKFQDRVTMTTDPSTSTAYMELRSLRSDDTAIYYCARDSGCCSGSTSDVWGKGTTVTVSS

SEQ ID NO: 1459 - protein, 9 aa, Artificial Sequence
  Description of Artificial Sequence: Synthetic heavy chain variable region CDR H1
YTFVHYGIS

SEQ ID NO: 1460 - DNA, 27 bp, Artificial Sequence
  Description of Artificial Sequence: Synthetic heavy chain variable region CDR H1
tacacctttgtccactatggtatcagt

SEQ ID NO: 1461 - protein, 17 aa, Artificial Sequence
  Description of Artificial Sequence: Synthetic heavy chain variable region CDR H2
WISAYNGNTNSALKFQD

SEQ ID NO: 1462 - DNA, 51 bp, Artificial Sequence
  Description of Artificial Sequence: Synthetic heavy chain variable region CDR H2
tggatcagcgcatacaatggtaatacaaactctgcactgaagttccaggac

SEQ ID NO: 1463 - protein, 14 aa, Artificial Sequence
  Description of Artificial Sequence: Synthetic heavy chain variable region CDR H3
ARDSGCCSGSTSDV

SEQ ID NO: 1464 - DNA, 42 bp, Artificial Sequence
  Description of Artificial Sequence: Synthetic heavy chain variable region CDR H3
gcgagagactcaggttgttgtagtggttccacctcagacgtc

SEQ ID NO: 1465 - DNA, 342 bp, Artificial Sequence
  Description of Artificial Sequence: Synthetic light chain variable region
gatattgtgatgactcagtctccactctcttcacctgtcacccttggacagccggcctccatctcctgcaggtctagtcaaagcctcgtgcacagtgatggaaacacctacttgagttggcttcaccagaggccaggccagcctccaagactcctaatttataagatttcccaccggttctctggggtcccagacagattcactggcagtggggcagggacagatttcacactgaaaatcagcagggtggaggctgaggatgtcggggtttattactgcatgcaagctacagaatttcctccgatgtacacttttggccaggggaccaaggtggagatcaaa

SEQ ID NO: 1466 - protein, 114 aa, Artificial Sequence
  Description of Artificial Sequence: Synthetic light chain variable region
DIVMTQSPLSSPVTLGQPASISCRSSQSLVHSDGNTYLSWLHQRPGQPPRLLIYKISHRFSGVPDRFTGSGAGTDFTLKISRVEAEDVGVYYCMQATEFPPMYTFGQGTKVEIK

SEQ ID NO: 1467 - protein, 16 aa, Artificial Sequence
  Description of Artificial Sequence: Synthetic light chain variable region CDR L1
RSSQSLVHSDGNTYLS

SEQ ID NO: 1468 - DNA, 48 bp, Artificial Sequence
  Description of Artificial Sequence: Synthetic light chain variable region CDR L1
aggtctagtcaaagcctcgtgcacagtgatggaaacacctacttgagt

SEQ ID NO: 1469 - protein, 7 aa, Artificial Sequence
  Description of Artificial Sequence: Synthetic light chain variable region CDR L2
KISHRFS

SEQ ID NO: 1470 - DNA, 21 bp, Artificial Sequence
  Description of Artificial Sequence: Synthetic light chain variable region CDR L2
aagatttcccaccggttctct

SEQ ID NO: 1471 - protein, 11 aa, Artificial Sequence
  Description of Artificial Sequence: Synthetic light chain variable region CDR L3
MQATEFPPMYT

SEQ ID NO: 1472 - DNA, 33 bp, Artificial Sequence
  Description of Artificial Sequence: Synthetic light chain variable region CDR L3
atgcaagctacagaatttcctccgatgtacact

SEQ ID NO: 1473 - DNA, 372 bp, Artificial Sequence
  Description of Artificial Sequence: Synthetic heavy chain variable region
gaggtgcagctggtggagacgggcccaggactggtgaagccttcggagaccctgtccctcacctgcactgtctctggtgactccatcagtggttactactggagctggatccggcagtccccagggaagggactggagtggattggctatatctattacagggggagcaccgactacaacccctccctcaagagtcgagtcaccatatcagtagacacgtccaagaaccagttctccctgaaactgagctctgtgaccgctgcggacacggccgtgtattactgtgcgagagataataaacaccatgattcgggaaattattacgcatactttgaccattggggccagggaaccctggtcaccgtctcctca

SEQ ID NO: 1474 - protein, 124 aa, Artificial Sequence
  Description of Artificial Sequence: Synthetic heavy chain variable region
EVQLVETGPGLVKPSETLSLTCTVSGDSISGYYWSWIRQSPGKGLEWIGYIYYRGSTDYNPSLKSRVTISVDTSKNQFSLKLSSVTAADTAVYYCARDNKHHDSGNYYAYFDHWGQGTLVTVSS

SEQ ID NO: 1475 - protein, 9 aa, Artificial Sequence
  Description of Artificial Sequence: Synthetic heavy chain variable region CDR H1
DSISGYYWS

SEQ ID NO: 1476 - DNA, 27 bp, Artificial Sequence
  Description of Artificial Sequence: Synthetic heavy chain variable region CDR H1
gactccatcagtggttactactggagc

SEQ ID NO: 1477 - protein, 16 aa, Artificial Sequence
  Description of Artificial Sequence: Synthetic heavy chain variable region CDR H2
YIYYRGSTDYNPSLKS

SEQ ID NO: 1478 - DNA, 48 bp, Artificial Sequence
  Description of Artificial Sequence: Synthetic heavy chain variable region CDR H2
tatatctattacagggggagcaccgactacaacccctccctcaagagt

SEQ ID NO: 1479 - protein, 18 aa, Artificial Sequence
  Description of Artificial Sequence: Synthetic heavy chain variable region CDR H3
ARDNKHHDSGNYYAYFDH

SEQ ID NO: 1480 - DNA, 54 bp, Artificial Sequence
  Description of Artificial Sequence: Synthetic heavy chain variable region CDR H3
gcgagagataataaacaccatgattcgggaaattattacgcatactttgaccat

SEQ ID NO: 1481 - DNA, 321 bp, Artificial Sequence
  Description of Artificial Sequence: Synthetic light chain variable region
gatattgtgatgactcagtctccatcctccctgtctgcatctgtaggagacagagtcaccatcacttgccgggcaagtcagaacattaacacctttttaaattggtatcagcacaaaccagggaaagcccctaaactcctgatctatggtgcatcccgtttgcagagtggggtcccatcaaggttcactggcagtggatctgggacagatttcactctcaccatcagcagtctgcaacctgaagattttgcaacttactcctgtcaacagagttacactacccggctcactttcggcggagggaccaaggtggaaatcaaa

SEQ ID NO: 1482 - protein, 107 aa, Artificial Sequence
  Description of Artificial Sequence: Synthetic light chain variable region
DIVMTQSPSSLSASVGDRVTITCRASQNINTFLNWYQHKPGKAPKLLIYGASRLQSGVPSRFTGSGSGTDFTLTISSLQPEDFATYSCQQSYTTRLTFGGGTKVEIK

SEQ ID NO: 1483 - protein, 11 aa, Artificial Sequence
  Description of Artificial Sequence: Synthetic light chain variable region CDR L1
RASQNINTFLN

SEQ ID NO: 1484 - DNA, 33 bp, Artificial Sequence
  Description of Artificial Sequence: Synthetic light chain variable region CDR L1
cgggcaagtcagaacattaacacctttttaaat

SEQ ID NO: 1485 - protein, 7 aa, Artificial Sequence
  Description of Artificial Sequence: Synthetic light chain variable region CDR L2
GASRLQS

SEQ ID NO: 1486 - DNA, 21 bp, Artificial Sequence
  Description of Artificial Sequence: Synthetic light chain variable region CDR L2
ggtgcatcccgtttgcagagt

SEQ ID NO: 1487 - protein, 9 aa, Artificial Sequence
  Description of Artificial Sequence: Synthetic light chain variable region CDR L3
QQSYTTRLT

SEQ ID NO: 1488 - DNA, 27 bp, Artificial Sequence
  Description of Artificial Sequence: Synthetic light chain variable region CDR L3
caacagagttacactacccggctcact

SEQ ID NO: 1489 - DNA, 375 bp, Artificial Sequence
  Description of Artificial Sequence: Synthetic heavy chain variable region
caggtccagctggtgcagtctgggactgaggtgaagaagcctggggcctcagtgaagatttcctgcaagacttctggatacaccttcactaataatgtaattcaatgggtgcgccaggcccccggacaaaggcttgagtggatgggatggatcagcgctggcaatggttacacaaaatattcagacaagttccaggacagagtcaccattaccagggacacatccgcgagcacagcctacatggaggtgagcagcctgacatctgaagacacggctatgtattactgtgcgagacaagtctcgactagtggctggcacgcaacgtcacaccggttcgccccctggggccagggaaccctggtcaccgtctcctca

SEQ ID NO: 1490 - protein, 125 aa, Artificial Sequence
  Description of Artificial Sequence: Synthetic heavy chain variable region
QVQLVQSGTEVKKPGASVKISCKTSGYTFTNNVIQWVRQAPGQRLEWMGWISAGNGYTKYSDKFQDRVTITRDTSASTAYMEVSSLTSEDTAMYYCARQVSTSGWHATSHRFAPWGQGTLVTVSS

SEQ ID NO: 1491 - protein, 9 aa, Artificial Sequence
  Description of Artificial Sequence: Synthetic heavy chain variable region CDR H1
YTFTNNVIQ

SEQ ID NO: 1492 - DNA, 27 bp, Artificial Sequence
  Description of Artificial Sequence: Synthetic heavy chain variable region CDR H1
tacaccttcactaataatgtaattcaa

SEQ ID NO: 1493 - protein, 17 aa, Artificial Sequence
  Description of Artificial Sequence: Synthetic heavy chain variable region CDR H2
WISAGNGYTKYSDKFQD

SEQ ID NO: 1494 - DNA, 51 bp, Artificial Sequence
  Description of Artificial Sequence: Synthetic heavy chain variable region CDR H2
tggatcagcgctggcaatggttacacaaaatattcagacaagttccaggac

SEQ ID NO: 1495 - protein, 18 aa, Artificial Sequence
  Description of Artificial Sequence: Synthetic heavy chain variable region CDR H3
ARQVSTSGWHATSHRFAP

SEQ ID NO: 1496 - DNA, 54 bp, Artificial Sequence
  Description of Artificial Sequence: Synthetic heavy chain variable region CDR H3
gcgagacaagtctcgactagtggctggcacgcaacgtcacaccggttcgccccc

SEQ ID NO: 1497 - DNA, 321 bp, Artificial Sequence
  Description of Artificial Sequence: Synthetic light chain variable region
gacatccagatgacccagtctccatcctccctgtctgcatctgtaggagacagagtcaccatcacttgccaggcgagtcagggcattagtagatatttaaattggtatcagcagaaaccagggaaagcccctaacctcctgatctacgatgcatccaatttggaaacaggggtcccatcaaggttcagtggaagtggatctgggacacattttactttaaccatcagcagcctgcagcctgaagatattgcaacatattactgtcaacagtatgataatctcccgctcactttcggcggagggaccaaggtggaaatcaaa

SEQ ID NO: 1498 - protein, 107 aa, Artificial Sequence
  Description of Artificial Sequence: Synthetic light chain variable region
DIQMTQSPSSLSASVGDRVTITCQASQGISRYLNWYQQKPGKAPNLLIYDASNLETGVPSRFSGSGSGTHFTLTISSLQPEDIATYYCQQYDNLPLTFGGGTKVEIK

SEQ ID NO: 1499 - protein, 11 aa, Artificial Sequence
  Description of Artificial Sequence: Synthetic light chain variable region CDR L1
QASQGISRYLN

SEQ ID NO: 1500 - DNA, 33 bp, Artificial Sequence
  Description of Artificial Sequence: Synthetic light chain variable region CDR L1
caggcgagtcagggcattagtagatatttaaat

SEQ ID NO: 1501 - protein, 7 aa, Artificial Sequence
  Description of Artificial Sequence: Synthetic light chain variable region CDR L2
DASNLET

SEQ ID NO: 1502 - DNA, 21 bp, Artificial Sequence
  Description of Artificial Sequence: Synthetic light chain variable region CDR L2
gatgcatccaatttggaaaca

SEQ ID NO: 1503 - protein, 9 aa, Artificial Sequence
  Description of Artificial Sequence: Synthetic light chain variable region CDR L3
QQYDNLPLT

SEQ ID NO: 1504 - DNA, 27 bp, Artificial Sequence
  Description of Artificial Sequence: Synthetic light chain variable region CDR L3
caacagtatgataatctcccgctcact

SEQ ID NO: 1505 - DNA, 363 bp, Artificial Sequence
  Description of Artificial Sequence: Synthetic heavy chain variable region
gaggtgcagctggtggagtctgggggaggcgtggtccagcctgggaggtccctgagactctcctgtgaagcctctggattcaccttcagtagttttagcatgcactgggtccgccaggctccgggcaaggggctggagtgggtggcagtgattttatatgatgggagtaatcaatactatgcagactccgtgaagggccgattcaccatctccagagacaattccaagaacacgctttatctgcaaatgaacaccctgagagctgaggacacggctatgtattactgtgcgaaatcatcatcgtcccatgttaactctcgacaagacaaatggggccagggcaccctggtcaccgtctcctca

SEQ ID NO: 1506 - protein, 121 aa, Artificial Sequence
  Description of Artificial Sequence: Synthetic heavy chain variable region
EVQLVESGGGVVQPGRSLRLSCEASGFTFSSFSMHWVRQAPGKGLEWVAVILYDGSNQYYADSVKGRFTISRDNSKNTLYLQMNTLRAEDTAMYYCAKSSSSHVNSRQDKWGQGTLVTVSS

SEQ ID NO: 1507 - protein, 9 aa, Artificial Sequence
  Description of Artificial Sequence: Synthetic heavy chain variable region CDR H1
FTFSSFSMH

SEQ ID NO: 1508 - DNA, 27 bp, Artificial Sequence
  Description of Artificial Sequence: Synthetic heavy chain variable region CDR H1
ttcaccttcagtagttttagcatgcac

SEQ ID NO: 1509 - protein, 17 aa, Artificial Sequence
  Description of Artificial Sequence: Synthetic heavy chain variable region CDR H2
VILYDGSNQYYADSVKG

SEQ ID NO: 1510 - DNA, 51 bp, Artificial Sequence
  Description of Artificial Sequence: Synthetic heavy chain variable region CDR H2
gtgattttatatgatgggagtaatcaatactatgcagactccgtgaagggc

SEQ ID NO: 1511 - protein, 14 aa, Artificial Sequence
  Description of Artificial Sequence: Synthetic heavy chain variable region CDR H3
AKSSSSHVNSRQDK

SEQ ID NO: 1512 - DNA, 42 bp, Artificial Sequence
  Description of Artificial Sequence: Synthetic heavy chain variable region CDR H3
gcgaaatcatcatcgtcccatgttaactctcgacaagacaaa

SEQ ID NO: 1513 - DNA, 318 bp, Artificial Sequence
  Description of Artificial Sequence: Synthetic light chain variable region
gaaattgtattgacacagtctccttccaccctgtctgcatctgtaggagacagagtcaccatcacttgccgggccagtcagagtattagtaggtggttggcctggtatcagcagaaaccaggggaagcccctaaactcctgatccacacggcgtctacattagaaagtggggtcccatcaaggttcagcggcagtggctctgggacagaattcactctcaccatcaacagcctgcagcctgatgatcttgcaacttattactgccaacagtattataattggtggacgttcggccaagggaccaaggtggagatcaaa

SEQ ID NO: 1514 - protein, 106 aa, Artificial Sequence
  Description of Artificial Sequence: Synthetic light chain variable region
EIVLTQSPSTLSASVGDRVTITCRASQSISRWLAWYQQKPGEAPKLLIHTASTLESGVPSRFSGSGSGTEFTLTINSLQPDDLATYYCQQYYNWWTFGQGTKVEIK

SEQ ID NO: 1515 - protein, 11 aa, Artificial Sequence
  Description of Artificial Sequence: Synthetic light chain variable region CDR L1
RASQSISRWLA

SEQ ID NO: 1516 - DNA, 33 bp, Artificial Sequence
  Description of Artificial Sequence: Synthetic light chain variable region CDR L1
cgggccagtcagagtattagtaggtggttggcc

SEQ ID NO: 1517 - protein, 7 aa, Artificial Sequence
  Description of Artificial Sequence: Synthetic light chain variable region CDR L2
TASTLES

SEQ ID NO: 1518 - DNA, 21 bp, Artificial Sequence
  Description of Artificial Sequence: Synthetic light chain variable region CDR L2
acggcgtctacattagaaagt

SEQ ID NO: 1519 - protein, 8 aa, Artificial Sequence
  Description of Artificial Sequence: Synthetic light chain variable region CDR L3
QQYYNWWT

SEQ ID NO: 1520 - DNA, 24 bp, Artificial Sequence
  Description of Artificial Sequence: Synthetic light chain variable region CDR L3
caacagtattataattggtggacg

SEQ ID NO: 1521 - DNA, 366 bp, Artificial Sequence
  Description of Artificial Sequence: Synthetic heavy chain variable region
gaggtgcagctgttggagtccggagctgaggtgaagaagcctggggcctcagtgaagatctcctgcaaggcctctggttacatctttaccagttatggtgtcagttgggtgcgacaggcccctggacaagggcttaagtggatgggatggatcagcggttacaatggtaacacatactatgaccagaaattccagggcagagtcaccatgaccacagacacatccacgaacacagcctacatggagttgaggagcctgacatctgacgacacggccgtatattactgtgcgagagattccttttcagagactgggactggatttcctgacttctggggccagggcaccctggtcaccgtctcttca

SEQ ID NO: 1522 - protein, 122 aa, Artificial Sequence
  Description of Artificial Sequence: Synthetic heavy chain variable region
EVQLLESGAEVKKPGASVKISCKASGYIFTSYGVSWVRQAPGQGLKWMGWISGYNGNTYYDQKFQGRVTMTTDTSTNTAYMELRSLTSDDTAVYYCARDSFSETGTGFPDFWGQGTLVTVSS

SEQ ID NO: 1523 - protein, 9 aa, Artificial Sequence
  Description of Artificial Sequence: Synthetic heavy chain variable region CDR H1
YIFTSYGVS

SEQ ID NO: 1524 - DNA, 27 bp, Artificial Sequence
  Description of Artificial Sequence: Synthetic heavy chain variable region CDR H1
tacatctttaccagttatggtgtcagt

SEQ ID NO: 1525 - protein, 17 aa, Artificial Sequence
  Description of Artificial Sequence: Synthetic heavy chain variable region CDR H2
WISGYNGNTYYDQKFQG

SEQ ID NO: 1526 - DNA, 51 bp, Artificial Sequence
  Description of Artificial Sequence: Synthetic heavy chain variable region CDR H2
tggatcagcggttacaatggtaacacatactatgaccagaaattccagggc

SEQ ID NO: 1527 - protein, 15 aa, Artificial Sequence
  Description of Artificial Sequence: Synthetic heavy chain variable region CDR H3
ARDSFSETGTGFPDF

SEQ ID NO: 1528 - DNA, 45 bp, Artificial Sequence
  Description of Artificial Sequence: Synthetic heavy chain variable region CDR H3
gcgagagattccttttcagagactgggactggatttcctgacttc

SEQ ID NO: 1529 - DNA, 336 bp, Artificial Sequence
  Description of Artificial Sequence: Synthetic light chain variable region
gaaattgtgttgacgcagtctccactctccctgcccgtcacccttggacagccggcctccatctcctgcaggtctagtcaaagcctcgaatacagtgatggaaacacctacttgaattggtttcagcagaggccaggccaatctccaaggcgcctaatttataaggtttctaaccgggactctggggtccccgacagattcagcggcagtgggtcaggcactgatttcacactgaaaatcagcagggtggaggctgaggatgttggagtttattactgcatgcaagccacacaccggcctcgcacgttcggccaagggaccaaagtggatatcaaa

SEQ ID NO: 1530 - protein, 112 aa, Artificial Sequence
  Description of Artificial Sequence: Synthetic light chain variable region
EIVLTQSPLSLPVTLGQPASISCRSSQSLEYSDGNTYLNWFQQRPGQSPRRLIYKVSNRDSGVPDRFSGSGSGTDFTLKISRVEAEDVGVYYCMQATHRPRTFGQGTKVDIK

SEQ ID NO: 1531 - protein, 16 aa, Artificial Sequence
  Description of Artificial Sequence: Synthetic light chain variable region CDR L1
RSSQSLEYSDGNTYLN

SEQ ID NO: 1532 - DNA, 48 bp, Artificial Sequence
  Description of Artificial Sequence: Synthetic light chain variable region CDR L1
aggtctagtcaaagcctcgaatacagtgatggaaacacctacttgaat

SEQ ID NO: 1533 - protein, 7 aa, Artificial Sequence
  Description of Artificial Sequence: Synthetic light chain variable region CDR L2
KVSNRDS

SEQ ID NO: 1534 - DNA, 21 bp, Artificial Sequence
  Description of Artificial Sequence: Synthetic light chain variable region CDR L2
aaggtttctaaccgggactct

SEQ ID NO: 1535 - protein, 9 aa, Artificial Sequence
  Description of Artificial Sequence: Synthetic light chain variable region CDR L3
MQATHRPRT

SEQ ID NO: 1536 - DNA, 27 bp, Artificial Sequence
  Description of Artificial Sequence: Synthetic light chain variable region CDR L3
atgcaagccacacaccggcctcgcacg

SEQ ID NO: 1537 - DNA, 357 bp, Artificial Sequence
  Description of Artificial Sequence: Synthetic heavy chain variable region
caggtccagctggtgcagtctggagcagaggtgaaaaagcccggggagtctctgaagatctcctgtaagggttttggatacagctttaacagttactggatcgcctgggtgcgccagatgcccgggaaaggcctggagtgcatgggcatcatctatcctggcgactctgataccagatacagcccgtccttccaagggcaggtcaccatctcagtcgacaagtccatcactaccgcctacctgcagtggagcagcctgaaggtctcggacaccgccatgtattactgtgcgaaaagtaatgtggggaatacaggttggaactactggggccagggaaccctggtcaccgtctcctca

SEQ ID NO: 1538 - protein, 119 aa, Artificial Sequence
  Description of Artificial Sequence: Synthetic heavy chain variable region
QVQLVQSGAEVKKPGESLKISCKGFGYSFNSYWIAWVRQMPGKGLECMGIIYPGDSDTRYSPSFQGQVTISVDKSITTAYLQWSSLKVSDTAMYYCAKSNVGNTGWNYWGQGTLVTVSS

SEQ ID NO: 1539 - protein, 9 aa, Artificial Sequence
  Description of Artificial Sequence: Synthetic heavy chain variable region CDR H1
YSFNSYWIA

SEQ ID NO: 1540 - DNA, 27 bp, Artificial Sequence
  Description of Artificial Sequence: Synthetic heavy chain variable region CDR H1
tacagctttaacagttactggatcgcc

SEQ ID NO: 1541 - protein, 17 aa, Artificial Sequence
  Description of Artificial Sequence: Synthetic heavy chain variable region CDR H2
IIYPGDSDTRYSPSFQG

SEQ ID NO: 1542 - DNA, 51 bp, Artificial Sequence
  Description of Artificial Sequence: Synthetic heavy chain variable region CDR H2
atcatctatcctggcgactctgataccagatacagcccgtccttccaaggg

SEQ ID NO: 1543 - protein, 12 aa, Artificial Sequence
  Description of Artificial Sequence: Synthetic heavy chain variable region CDR H3
AKSNVGNTGWNY

SEQ ID NO: 1544 - DNA, 36 bp, Artificial Sequence
  Description of Artificial Sequence: Synthetic heavy chain variable region CDR H3
gcgaaaagtaatgtggggaatacaggttggaactac

SEQ ID NO: 1545 - DNA, 324 bp, Artificial Sequence
  Description of Artificial Sequence: Synthetic light chain variable region
gaaattgtattgacacagtctccagccaccctgtctttgtctccaggggaaagagccaccctctcctgcagggccagtcacagtgttgccaccgacctagcctggtaccagcagaaacctggccaggctcccaggctcctcatctatgatgcatccaagagggccactgacgtcccagccaggttcagtggcagtgggtctgggacagacttcactctcaccatcagcagcctagagcctgaagatgttgcagtttattactgtcaggaagttaggaactggcctccgtgcacttttggccaggggaccaaagtggatatcaaa

SEQ ID NO: 1546 - protein, 108 aa, Artificial Sequence
  Description of Artificial Sequence: Synthetic light chain variable region
EIVLTQSPATLSLSPGERATLSCRASHSVATDLAWYQQKPGQAPRLLIYDASKRATDVPARFSGSGSGTDFTLTISSLEPEDVAVYYCQEVRNWPPCTFGQGTKVDIK

SEQ ID NO: 1547 - protein, 11 aa, Artificial Sequence
  Description of Artificial Sequence: Synthetic light chain variable region CDR L1
RASHSVATDLA

SEQ ID NO: 1548 - DNA, 33 bp, Artificial Sequence
  Description of Artificial Sequence: Synthetic light chain variable region CDR L1
agggccagtcacagtgttgccaccgacctagcc

SEQ ID NO: 1549 - protein, 7 aa, Artificial Sequence
  Description of Artificial Sequence: Synthetic light chain variable region CDR L2
DASKRAT

SEQ ID NO: 1550 - DNA, 21 bp, Artificial Sequence
  Description of Artificial Sequence: Synthetic light chain variable region CDR L2
gatgcatccaagagggccact

SEQ ID NO: 1551 - protein, 10 aa, Artificial Sequence
  Description of Artificial Sequence: Synthetic light chain variable region CDR L3
QEVRNWPPCT

SEQ ID NO: 1552 - DNA, 30 bp, Artificial Sequence
  Description of Artificial Sequence: Synthetic light chain variable region CDR L3
caggaagttaggaactggcctccgtgcact

SEQ ID NO: 1553 - DNA, 369 bp, Artificial Sequence
  Description of Artificial Sequence: Synthetic heavy chain variable region
gaggtgcagctgcaggagtccggctctcgactggtgaagccttcacagaccctgtccctcacctgctctgtctctggtggctccctcaacgcaggcggttacctgtggagctggatccgtcagccaccagggaagggcctggagtgggttgggtacatctatcctagtgggactacctactacaacccgtccctgcagagtcgaatcagcatttcacaagacaggtccaggaaccagttctccctgagcgtagcgtctgtgaccgccgcggacacggccgtctattactgtgccagatgtgggaatgagtacggtgaggtccatccttttgatatttggggccaagggaccacggtcaccgtctcctca

SEQ ID NO: 1554 - protein, 123 aa, Artificial Sequence
  Description of Artificial Sequence: Synthetic heavy chain variable region
EVQLQESGSRLVKPSQTLSLTCSVSGGSLNAGGYLWSWIRQPPGKGLEWVGYIYPSGTTYYNPSLQSRISISQDRSRNQFSLSVASVTAADTAVYYCARCGNEYGEVHPFDIWGQGTTVTVSS

SEQ ID NO: 1555 - protein, 11 aa, Artificial Sequence
  Description of Artificial Sequence: Synthetic heavy chain variable region CDR H1
GSLNAGGYLWS

SEQ ID NO: 1556 - DNA, 33 bp, Artificial Sequence
  Description of Artificial Sequence: Synthetic heavy chain variable region CDR H1
ggctccctcaacgcaggcggttacctgtggagc

SEQ ID NO: 1557 - protein, 16 aa, Artificial Sequence
  Description of Artificial Sequence: Synthetic heavy chain variable region CDR H2
YIYPSGTTYYNPSLQS

SEQ ID NO: 1558 - DNA, 48 bp, Artificial Sequence
  Description of Artificial Sequence: Synthetic heavy chain variable region CDR H2
tacatctatcctagtgggactacctactacaacccgtccctgcagagt

SEQ ID NO: 1559 - protein, 15 aa, Artificial Sequence
  Description of Artificial Sequence: Synthetic heavy chain variable region CDR H3
ARCGNEYGEVHPFDI

SEQ ID NO: 1560 - DNA, 45 bp, Artificial Sequence
  Description of Artificial Sequence: Synthetic heavy chain variable region CDR H3
gccagatgtgggaatgagtacggtgaggtccatccttttgatatt

SEQ ID NO: 1561 - DNA, 324 bp, Artificial Sequence
  Description of Artificial Sequence: Synthetic light chain variable region
gaaattgtattgacacagtctccaggcaccctgtctttgtctccaggggaaagagccaccctctcctgccggggcagtcctattgttggcaacaactacttagcctggtaccagcagaagcctggccaggctcccaggctcctcatctatgctgcatccatcagggccactggcatcccagacaggttcagtggcagtgggtctgggacagacttcactctcaccatcagcagactagagcctgaagattttgcagtctattactgtcagcaatatggcagctcaccgtggacgttcggccaagggaccaaagtggatatcaaa

SEQ ID NO: 1562 - protein, 108 aa, Artificial Sequence
  Description of Artificial Sequence: Synthetic light chain variable region
EIVLTQSPGTLSLSPGERATLSCRGSPIVGNNYLAWYQQKPGQAPRLLIYAASIRATGIPDRFSGSGSGTDFTLTISRLEPEDFAVYYCQQYGSSPWTFGQGTKVDIK

SEQ ID NO: 1563 - protein, 12 aa, Artificial Sequence
  Description of Artificial Sequence: Synthetic light chain variable region CDR L1
RGSPIVGNNYLA

SEQ ID NO: 1564 - DNA, 36 bp, Artificial Sequence
  Description of Artificial Sequence: Synthetic light chain variable region CDR L1
cggggcagtcctattgttggcaacaactacttagcc

SEQ ID NO: 1565 - protein, 7 aa, Artificial Sequence
  Description of Artificial Sequence: Synthetic light chain variable region CDR L2
AASIRAT

SEQ ID NO: 1566 - DNA, 21 bp, Artificial Sequence
  Description of Artificial Sequence: Synthetic light chain variable region CDR L2
gctgcatccatcagggccact

SEQ ID NO: 1567 - protein, 9 aa, Artificial Sequence
  Description of Artificial Sequence: Synthetic light chain variable region CDR L3
QQYGSSPWT

SEQ ID NO: 1568 - DNA, 27 bp, Artificial Sequence
  Description of Artificial Sequence: Synthetic light chain variable region CDR L3
cagcaatatggcagctcaccgtggacg

SEQ ID NO: 1569 - DNA, 366 bp, Artificial Sequence
  Description of Artificial Sequence: Synthetic heavy chain variable region
caggtgcagctggtgcagtctggagctgaggtgaagaagcctggggcctcagtgaaggtctcctgcaaggcttctggttacatctttaccagttatggtgtcagctgggtgcgacaggcccctggacaagggcttaagtggatgggatggatcagcggttacaatggtaacacaaactatgaccagaaactccagggcagagtcaccatgaccacagacacatccacgagcacagcctacatggagctgaggagcctgacatctgacgacacggccgtttattactgtgcgagagattcattttcagagactgggactgggtttcctgacttctggggccagggaaccctggtcaccgtctcctca

SEQ ID NO: 1570 - protein, 122 aa, Artificial Sequence
  Description of Artificial Sequence: Synthetic heavy chain variable region
QVQLVQSGAEVKKPGASVKVSCKASGYIFTSYGVSWVRQAPGQGLKWMGWISGYNGNTNYDQKLQGRVTMTTDTSTSTAYMELRSLTSDDTAVYYCARDSFSETGTGFPDFWGQGTLVTVSS

SEQ ID NO: 1571 - protein, 9 aa, Artificial Sequence
  Description of Artificial Sequence: Synthetic heavy chain variable region CDR H1
YIFTSYGVS

SEQ ID NO: 1572 - DNA, 27 bp, Artificial Sequence
  Description of Artificial Sequence: Synthetic heavy chain variable region CDR H1
tacatctttaccagttatggtgtcagc

SEQ ID NO: 1573 - protein, 17 aa, Artificial Sequence
  Description of Artificial Sequence: Synthetic heavy chain variable region CDR H2
WISGYNGNTNYDQKLQG

SEQ ID NO: 1574 - DNA, 51 bp, Artificial Sequence
  Description of Artificial Sequence: Synthetic heavy chain variable region CDR H2
tggatcagcggttacaatggtaacacaaactatgaccagaaactccagggc

SEQ ID NO: 1575 - protein, 15 aa, Artificial Sequence
  Description of Artificial Sequence: Synthetic heavy chain variable region CDR H3
ARDSFSETGTGFPDF

SEQ ID NO: 1576 - DNA, 45 bp, Artificial Sequence
  Description of Artificial Sequence: Synthetic heavy chain variable region CDR H3
gcgagagattcattttcagagactgggactgggtttcctgacttc

SEQ ID NO: 1577 - DNA, 336 bp, Artificial Sequence
  Description of Artificial Sequence: Synthetic light chain variable region
gacatccagatgacccagtctccactctccctgcccgtcacccttggacagccggcctccatctcctgcaggtctagtcaaagcctcgaatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggagtttattactgcatgcaagccacacaccggcctcgcacgttcggccaagggaccaagctggagatcaaa

SEQ ID NO: 1578 - protein, 112 aa, Artificial Sequence
  Description of Artificial Sequence: Synthetic light chain variable region
DIQMTQSPLSLPVTLGQPASISCRSSQSLEYSDGNTYLNWFQQRPGQSPRRLIYKVSNRDSGVPDRFSGSGSGTDFTLKISRVEAEDVGVYYCMQATHRPRTFGQGTKLEIK

SEQ ID NO: 1579 - protein, 16 aa, Artificial Sequence
  Description of Artificial Sequence: Synthetic light chain variable region CDR L1
RSSQSLEYSDGNTYLN

SEQ ID NO: 1580 - DNA, 48 bp, Artificial Sequence; identical to SEQ ID NO: 1532
  Description of Artificial Sequence: Synthetic light chain variable region CDR L1

SEQ ID NO: 1581 - protein, 7 aa, Artificial Sequence
  Description of Artificial Sequence: Synthetic light chain variable region CDR L2
KVSNRDS

SEQ ID NO: 1582 - DNA, 21 bp, Artificial Sequence
  Description of Artificial Sequence: Synthetic light chain variable region CDR L2
aaggtttctaaccgggactct

SEQ ID NO: 1583 - protein, 9 aa, Artificial Sequence
  Description of Artificial Sequence: Synthetic light chain variable region CDR L3
MQATHRPRT

SEQ ID NO: 1584 - DNA, 27 bp, Artificial Sequence
  Description of Artificial Sequence: Synthetic light chain variable region CDR L3
atgcaagccacacaccggcctcgcacg

SEQ ID NO: 1585 - DNA, 372 bp, Artificial Sequence
  Description of Artificial Sequence: Synthetic heavy chain variable region
gaggtgcagctggtggagtctgggggaggcgtggtccagcctgggaggtccctgagactctcctgtgcagcgtctggattcaccttcagtagtttttctatgcactgggtccgccaggctccaggcaaggggctggagtgggtggcacttatatcatctgacgagaggaattcatactacgcagactccgtgaagggccgattcaccatctccagagacaattccaagaacacgctgtatctgcaaataagcaggctgaaagtcgaggacacggctgtgtattattgtgcgagagaggcatacgaagagtgggagctaacgatggggaaccttgaccactggggccagggaaccctggtcaccgtctcctca

SEQ ID NO: 1586 - protein, 124 aa, Artificial Sequence
  Description of Artificial Sequence: Synthetic heavy chain variable region
EVQLVESGGGVVQPGRSLRLSCAASGFTFSSFSMHWVRQAPGKGLEWVALISSDERNSYYADSVKGRFTISRDNSKNTLYLQISRLKVEDTAVYYCAREAYEEWELTMGNLDHWGQGTLVTVSS

SEQ ID NO: 1587 - protein, 9 aa, Artificial Sequence
  Description of Artificial Sequence: Synthetic heavy chain variable region CDR H1
FTFSSFSMH

SEQ ID NO: 1588 - DNA, 27 bp, Artificial Sequence
  Description of Artificial Sequence: Synthetic heavy chain variable region CDR H1
ttcaccttcagtagtttttctatgcac

SEQ ID NO: 1589 - protein, 17 aa, Artificial Sequence
  Description of Artificial Sequence: Synthetic heavy chain variable region CDR H2
LISSDERNSYYADSVKG

SEQ ID NO: 1590 - DNA, 51 bp, Artificial Sequence
  Description of Artificial Sequence: Synthetic heavy chain variable region CDR H2
cttatatcatctgacgagaggaattcatactacgcagactccgtgaagggc

SEQ ID NO: 1591 - protein, 17 aa, Artificial Sequence
  Description of Artificial Sequence: Synthetic heavy chain variable region CDR H3
AREAYEEWELTMGNLDH

SEQ ID NO: 1592 - DNA, 51 bp, Artificial Sequence
  Description of Artificial Sequence: Synthetic heavy chain variable region CDR H3
gcgagagaggcatacgaagagtgggagctaacgatggggaaccttgaccac

SEQ ID NO: 1593 - DNA, 321 bp, Artificial Sequence
  Description of Artificial Sequence: Synthetic light chain variable region
gacatccagttgacccagtctccatcctccctgtctgcatctgtaggagacagagtcaccatcacttgccgggcaagtcagggcattggaaatgatttaggctggtatcagcagaaaccagggaaagcccctaagcgcctgatctatagtacatacagcttgcaaagtggggtcccatcaaggttcagcggcagtggatctgggacagaattcactctcacaatcagcagcctgcagcctgaagattttgcaacttattactgtctacagcataatcgttaccccttcactttcggccctgggaccaagctggagatcaaa

SEQ ID NO: 1594 - protein, 107 aa, Artificial Sequence
  Description of Artificial Sequence: Synthetic light chain variable region
DIQLTQSPSSLSASVGDRVTITCRASQGIGNDLGWYQQKPGKAPKRLIYSTYSLQSGVPSRFSGSGSGTEFTLTISSLQPEDFATYYCLQHNRYPFTFGPGTKLEIK

SEQ ID NO: 1595 - protein, 11 aa, Artificial Sequence
  Description of Artificial Sequence: Synthetic light chain variable region CDR L1
RASQGIGNDLG

SEQ ID NO: 1596 - DNA, 33 bp, Artificial Sequence
  Description of Artificial Sequence: Synthetic light chain variable region CDR L1
cgggcaagtcagggcattggaaatgatttaggc

SEQ ID NO: 1597 - protein, 7 aa, Artificial Sequence
  Description of Artificial Sequence: Synthetic light chain variable region CDR L2
STYSLQS

SEQ ID NO: 1598 - DNA, 21 bp, Artificial Sequence
  Description of Artificial Sequence: Synthetic light chain variable region CDR L2
agtacatacagcttgcaaagt

SEQ ID NO: 1599 - protein, 9 aa, Artificial Sequence
  Description of Artificial Sequence: Synthetic light chain variable region CDR L3
LQHNRYPFT

SEQ ID NO: 1600 - DNA, 27 bp, Artificial Sequence
  Description of Artificial Sequence: Synthetic light chain variable region CDR L3
ctacagcataatcgttaccccttcact

SEQ ID NO: 1601 - DNA, 360 bp, Artificial Sequence
  Description of Artificial Sequence: Synthetic heavy chain variable region
caggtgcagctgcaggagtcgggcccaggactggtgaagccttcggagaccctgtccctcacctgcactgtctctggtgcctccgtcaccactaatacttactactggacctggatccggcagcccccagggaaggaactggagtggattggatatatccatcacactgggaacacccactacaacccctccctcgagagtcgactcaccatgtcactagacacgtccaggaaccagttctctctgaaccttaggtctgccaccactgcggacacggccgtttattactgtgcgagaggcgaacattttgcgtactggtggggaaactggggccagggagccctggtcaccgtctcctca

SEQ ID NO: 1602 - protein, 120 aa, Artificial Sequence
  Description of Artificial Sequence: Synthetic heavy chain variable region
QVQLQESGPGLVKPSETLSLTCTVSGASVTTNTYYWTWIRQPPGKELEWIGYIHHTGNTHYNPSLESRLTMSLDTSRNQFSLNLRSATTADTAVYYCARGEHFAYWWGNWGQGALVTVSS

SEQ ID NO: 1603 - protein, 11 aa, Artificial Sequence
  Description of Artificial Sequence: Synthetic heavy chain variable region CDR H1
ASVTTNTYYWT

SEQ ID NO: 1604 - DNA, 33 bp, Artificial Sequence
  Description of Artificial Sequence: Synthetic heavy chain variable region CDR H1
gcctccgtcaccactaatacttactactggacc

SEQ ID NO: 1605 - protein, 16 aa, Artificial Sequence
  Description of Artificial Sequence: Synthetic heavy chain variable region CDR H2
YIHHTGNTHYNPSLES

SEQ ID NO: 1606 - DNA, 48 bp, Artificial Sequence
  Description of Artificial Sequence: Synthetic heavy chain variable region CDR H2
tatatccatcacactgggaacacccactacaacccctccctcgagagt

SEQ ID NO: 1607 - protein, 12 aa, Artificial Sequence
  Description of Artificial Sequence: Synthetic heavy chain variable region CDR H3
ARGEHFAYWWGN

SEQ ID NO: 1608 - DNA, 36 bp, Artificial Sequence
  Description of Artificial Sequence: Synthetic heavy chain variable region CDR H3
gcgagaggcgaacattttgcgtactggtggggaaac

SEQ ID NO: 1609 - DNA, 321 bp, Artificial Sequence
  Description of Artificial Sequence: Synthetic light chain variable region
gacatccgggtgacccagtctccatcttccgtgtctgcatctgtaggagacagagtcaccatcacttgtcgggcgagtcagggtattgccagatggttagcctggtatcagcagaaaccagggaaagcccctaaactcctgatctatgctgcatccagtttgcaaggtggggtcccatcaaggttcagcggcagtggatatgggacagatttcactctcaccatcagcagcctgcagcctgaagattttgcaacttactactgtcaacaggctaacagttttcctcgaacgttcggccaagggaccaaggtggagatcaaa

SEQ ID NO: 1610 - protein, 107 aa, Artificial Sequence
  Description of Artificial Sequence: Synthetic light chain variable region
DIRVTQSPSSVSASVGDRVTITCRASQGIARWLAWYQQKPGKAPKLLIYAASSLQGGVPSRFSGSGYGTDFTLTISSLQPEDFATYYCQQANSFPRTFGQGTKVEIK

SEQ ID NO: 1611 - protein, 11 aa, Artificial Sequence
  Description of Artificial Sequence: Synthetic light chain variable region CDR L1
RASQGIARWLA

SEQ ID NO: 1612 - DNA, 33 bp, Artificial Sequence
  Description of Artificial Sequence: Synthetic light chain variable region CDR L1
cgggcgagtcagggtattgccagatggttagcc

SEQ ID NO: 1613 - protein, 7 aa, Artificial Sequence
  Description of Artificial Sequence: Synthetic light chain variable region CDR L2
AASSLQG

SEQ ID NO: 1614 - DNA, 21 bp, Artificial Sequence
  Description of Artificial Sequence: Synthetic light chain variable region CDR L2
gctgcatccagtttgcaaggt

SEQ ID NO: 1615 - protein, 9 aa, Artificial Sequence
  Description of Artificial Sequence: Synthetic light chain variable region CDR L3
QQANSFPRT

SEQ ID NO: 1616 - DNA, 27 bp, Artificial Sequence
  Description of Artificial Sequence: Synthetic light chain variable region CDR L3
caacaggctaacagttttcctcgaacg

SEQ ID NO: 1617 - DNA, 363 bp, Artificial Sequence
  Description of Artificial Sequence: Synthetic heavy chain variable region
caggtccagcttgtacagtctgggcctgaggtgaagaagcctggggcctcagtgaaggtctcctgcgaggcttctggatacaccttcaccgacttctttgtgcactgggtgcgacaggcccctggtgaggggcttgtgtggttgggatgggtcaaccctctcagtggcgccacaaagtatgcacagaactttcagggcagggtcaccatgaccagtgacacgtccatcaccacagcctacatggcactgagcagcctgagacatgacgacacggccgtctattactgtacgagccagacttcaccttataccccgggcgctatgggcgtttggggccaagggaccacggtcaccgtctcctca

SEQ ID NO: 1618 - protein, 121 aa, Artificial Sequence
  Description of Artificial Sequence: Synthetic heavy chain variable region
QVQLVQSGPEVKKPGASVKVSCEASGYTFTDFFVHWVRQAPGEGLVWLGWVNPLSGATKYAQNFQGRVTMTSDTSITTAYMALSSLRHDDTAVYYCTSQTSPYTPGAMGVWGQGTTVTVSS

SEQ ID NO: 1619 - protein, 9 aa, Artificial Sequence
  Description of Artificial Sequence: Synthetic heavy chain variable region CDR H1
YTFTDFFVH

SEQ ID NO: 1620 - DNA, 27 bp, Artificial Sequence
  Description of Artificial Sequence: Synthetic heavy chain variable region CDR H1
tacaccttcaccgacttctttgtgcac

SEQ ID NO: 1621 - protein, 17 aa, Artificial Sequence
  Description of Artificial Sequence: Synthetic heavy chain variable region CDR H2
WVNPLSGATKYAQNFQG

SEQ ID NO: 1622 - DNA, 51 bp, Artificial Sequence
  Description of Artificial Sequence: Synthetic heavy chain variable region CDR H2
tgggtcaaccctctcagtggcgccacaaagtatgcacagaactttcagggc

SEQ ID NO: 1623 - protein, 14 aa, Artificial Sequence
  Description of Artificial Sequence: Synthetic heavy chain variable region CDR H3
TSQTSPYTPGAMGV

SEQ ID NO: 1624 - DNA, 42 bp, Artificial Sequence
  Description of Artificial Sequence: Synthetic heavy chain variable region CDR H3
acgagccagacttcaccttataccccgggcgctatgggcgtt

SEQ ID NO: 1625 - DNA, 321 bp, Artificial Sequence
  Description of Artificial Sequence: Synthetic light chain variable region
gacatccgggtgacccagtctccagcctccctgtctgcatttgttggagacagagtcaccatcacttgccgggcaagtccggccattagcggctatttaagttggtatcagcagaaggcaggcaaagcccctaagatcctgatctatgatgcatctaatttgtatagtggggccccatcacggttcagtggcagtagatctgggacagatttcactctcaccatcaccagtctgcaacctgaagattttgcaacttactactgtcaacagacttacaatggcctaatcgctttcggccctgggaccaaggtggaaatcaaa

SEQ ID NO: 1626 - protein, 107 aa, Artificial Sequence
  Description of Artificial Sequence: Synthetic light chain variable region
DIRVTQSPASLSAFVGDRVTITCRASPAISGYLSWYQQKAGKAPKILIYDASNLYSGAPSRFSGSRSGTDFTLTITSLQPEDFATYYCQQTYNGLIAFGPGTKVEIK

SEQ ID NO: 1627 - protein, 11 aa, Artificial Sequence
  Description of Artificial Sequence: Synthetic light chain variable region CDR L1
RASPAISGYLS

SEQ ID NO: 1628 - DNA, 33 bp, Artificial Sequence
  Description of Artificial Sequence: Synthetic light chain variable region CDR L1
cgggcaagtccggccattagcggctatttaagt

SEQ ID NO: 1629 - protein, 7 aa, Artificial Sequence
  Description of Artificial Sequence: Synthetic light chain variable region CDR L2
DASNLYS

SEQ ID NO: 1630 - DNA, 21 bp, Artificial Sequence
  Description of Artificial Sequence: Synthetic light chain variable region CDR L2
gatgcatctaatttgtatagt

SEQ ID NO: 1631 - protein, 9 aa, Artificial Sequence
  Description of Artificial Sequence: Synthetic light chain variable region CDR L3
QQTYNGLIA

SEQ ID NO: 1632 - DNA, 27 bp, Artificial Sequence
  Description of Artificial Sequence: Synthetic light chain variable region CDR L3
caacagacttacaatggcctaatcgct

SEQ ID NO: 1633 - DNA, 366 bp, Artificial Sequence
  Description of Artificial Sequence: Synthetic heavy chain variable region
gaggtgcagctgttggagtctgggggaggcgtggtccagcctgggaagtccctgagactctcctgtgcagcctctggattcaccttcaatacctatgctatacactgggtccgccaggctccaggcaagggcctggagtgggtggcagctatatcatatgatggaagcaatgaatactactcaaactccgtgaagggccgattcaccatctccagagacaattccaagtacacgctggagctgcaaatgaacagcctgagacctgaggacacggctgtgtattactgtgcgagaggcgcctcctactactatgtgagtagtgaccttggctactggggccagggaaccctggtcaccgtctcctca

SEQ ID NO: 1634 - protein, 122 aa, Artificial Sequence
  Description of Artificial Sequence: Synthetic heavy chain variable region
EVQLLESGGGVVQPGKSLRLSCAASGFTFNTYAIHWVRQAPGKGLEWVAAISYDGSNEYYSNSVKGRFTISRDNSKYTLELQMNSLRPEDTAVYYCARGASYYYVSSDLGYWGQGTLVTVSS

SEQ ID NO: 1635 - protein, 9 aa, Artificial Sequence
  Description of Artificial Sequence: Synthetic heavy chain variable region CDR H1
FTFNTYAIH

SEQ ID NO: 1636 - DNA, 27 bp, Artificial Sequence
  Description of Artificial Sequence: Synthetic heavy chain variable region CDR H1
ttcaccttcaatacctatgctatacac

SEQ ID NO: 1637 - protein, 17 aa, Artificial Sequence
  Description of Artificial Sequence: Synthetic heavy chain variable region CDR H2
AISYDGSNEYYSNSVKG

SEQ ID NO: 1638 - DNA, 51 bp, Artificial Sequence
  Description of Artificial Sequence: Synthetic heavy chain variable region CDR H2
gctatatcatatgatggaagcaatgaatactactcaaactccgtgaagggc

SEQ ID NO: 1639 - protein, 15 aa, Artificial Sequence
  Description of Artificial Sequence: Synthetic heavy chain variable region CDR H3
ARGASYYYVSSDLGY

SEQ ID NO: 1640 - DNA, 45 bp, Artificial Sequence
  Description of Artificial Sequence: Synthetic heavy chain variable region CDR H3
gcgagaggcgcctcctactactatgtgagtagtgaccttggctac

SEQ ID NO: 1641 - DNA, 333 bp, Artificial Sequence
  Description of Artificial Sequence: Synthetic light chain variable region
cagtctgtcgtgacgcagccgccctcagtgtctggggccccagggcagagggtcaccatctcctgcactgggagcagctccaacatcgggtcaggttatgatgtgcactggtaccagcagcttccaggaacagcccccaaagtcgtcatctatggtaacatcaatcggccctcaggggtccctgagcgattctctggctccaagtctggcacctcagcctccctggccatcactgggctccaggctgaggatgaggctgattattactgccagtcctatgacagcctgagtgcctcttgggtgttcggcggagggaccaagctgaccgtccta

SEQ ID NO: 1642 - protein, 111 aa, Artificial Sequence
  Description of Artificial Sequence: Synthetic light chain variable region
QSVVTQPPSVSGAPGQRVTISCTGSSSNIGSGYDVHWYQQLPGTAPKVVIYGNINRPSGVPERFSGSKSGTSASLAITGLQAEDEADYYCQSYDSLSASWVFGGGTKLTVL

SEQ ID NO: 1643 - protein, 14 aa, Artificial Sequence
  Description of Artificial Sequence: Synthetic light chain variable region CDR L1
TGSSSNIGSGYDVH

SEQ ID NO: 1644 - DNA, 42 bp, Artificial Sequence; identical to SEQ ID NO: 284
  Description of Artificial Sequence: Synthetic light chain variable region CDR L1

SEQ ID NO: 1645 - protein, 7 aa, Artificial Sequence
  Description of Artificial Sequence: Synthetic light chain variable region CDR L2
GNINRPS

SEQ ID NO: 1646 - DNA, 21 bp, Artificial Sequence
  Description of Artificial Sequence: Synthetic light chain variable region CDR L2
ggtaacatcaatcggccctca

SEQ ID NO: 1647 - protein, 11 aa, Artificial Sequence
  Description of Artificial Sequence: Synthetic light chain variable region CDR L3
QSYDSLSASWV

SEQ ID NO: 1648 - DNA, 33 bp, Artificial Sequence; identical to SEQ ID NO: 288
  Description of Artificial Sequence: Synthetic light chain variable region CDR L3

SEQ ID NO: 1649 - DNA, 375 bp, Artificial Sequence
  Description of Artificial Sequence: Synthetic heavy chain variable region
caggtccagcttgtgcagtctggggctgaggtgaagaagcctgggtcctcggtgaaggtctcctgcaaggcctctggaggcaccttcagcggccacgctatcaactgggtgcgacaggcccctggacaagggctcgaatggatgggagggatcatccatatatttgggacagtaaactacgctccgaagttccagggcagagtcacgatcaccgcggacgcatccacgggcacagtttacatggagttgagcagcctgatatctgaggacacggccgtatattattgtgcgagagatgcttacgaagtgtggactggttcttatctccccccttttgacgactggggccagggaaccctggtcactgtctcctca

SEQ ID NO: 1650 - protein, 125 aa, Artificial Sequence
  Description of Artificial Sequence: Synthetic heavy chain variable region
QVQLVQSGAEVKKPGSSVKVSCKASGGTFSGHAINWVRQAPGQGLEWMGGIIHIFGTVNYAPKFQGRVTITADASTGTVYMELSSLISEDTAVYYCARDAYEVWTGSYLPPFDDWGQGTLVTVSS

SEQ ID NO: 1651 - protein, 9 aa, Artificial Sequence
  Description of Artificial Sequence: Synthetic heavy chain variable region CDR H1
GTFSGHAIN

SEQ ID NO: 1652 - DNA, 27 bp, Artificial Sequence
  Description of Artificial Sequence: Synthetic heavy chain variable region CDR H1
ggcaccttcagcggccacgctatcaac

SEQ ID NO: 1653 - protein, 17 aa, Artificial Sequence
  Description of Artificial Sequence: Synthetic heavy chain variable region CDR H2
GIIHIFGTVNYAPKFQG

SEQ ID NO: 1654 - DNA, 51 bp, Artificial Sequence; identical to SEQ ID NO: 1174
  Description of Artificial Sequence: Synthetic heavy chain variable region CDR H2

SEQ ID NO: 1655 - protein, 18 aa, Artificial Sequence
  Description of Artificial Sequence: Synthetic heavy chain variable region CDR H3
ARDAYEVWTGSYLPPFDD

SEQ ID NO: 1656 - DNA, 54 bp, Artificial Sequence
  Description of Artificial Sequence: Synthetic heavy chain variable region CDR H3
gcgagagatgcttacgaagtgtggactggttcttatctccccccttttgacgac

SEQ ID NO: 1657 - DNA, 324 bp, Artificial Sequence
  Description of Artificial Sequence: Synthetic light chain variable region
gatattgtgatgacgcagtctccaggcaccctgtctttgtctcccggggacagagtcaccctctcctgcagggccagtcagactgttacaagcagctacttagcctggtaccagcagaaacctggccaggctcccaggctcctcatctatggtgcattcaccagggccactggcatcccagacaggttcagtggcagtgggtctgggacagacttcactctcagcatcagcagactggagcctgaagattttgcagtatattattgtcagcagtatggtagctcattcctcactttcggcggagggaccaaagtggatatcaaa

SEQ ID NO: 1658 - protein, 108 aa, Artificial Sequence
  Description of Artificial Sequence: Synthetic light chain variable region
DIVMTQSPGTLSLSPGDRVTLSCRASQTVTSSYLAWYQQKPGQAPRLLIYGAFTRATGIPDRFSGSGSGTDFTLSISRLEPEDFAVYYCQQYGSSFLTFGGGTKVDIK

SEQ ID NO: 1659 - protein, 12 aa, Artificial Sequence
  Description of Artificial Sequence: Synthetic light chain variable region CDR L1
RASQTVTSSYLA

SEQ ID NO: 1660 - DNA, 36 bp, Artificial Sequence; identical to SEQ ID NO: 844
  Description of Artificial Sequence: Synthetic light chain variable region CDR L1

SEQ ID NO: 1661 - protein, 7 aa, Artificial Sequence
  Description of Artificial Sequence: Synthetic light chain variable region CDR L2
GAFTRAT

SEQ ID NO: 1662 - DNA, 21 bp, Artificial Sequence
  Description of Artificial Sequence: Synthetic light chain variable region CDR L2
ggtgcattcaccagggccact

SEQ ID NO: 1663 - protein, 9 aa, Artificial Sequence
  Description of Artificial Sequence: Synthetic light chain variable region CDR L3
QQYGSSFLT

SEQ ID NO: 1664 - DNA, 27 bp, Artificial Sequence
  Description of Artificial Sequence: Synthetic light chain variable region CDR L3
cagcagtatggtagctcattcctcact

SEQ ID NO: 1665 - DNA, 369 bp, Artificial Sequence
  Description of Artificial Sequence: Synthetic heavy chain variable region
gaggtgcagctggtggaatctgggggaggcctggtcaggcctggggggtccctgagactctcctgtgcagcctctggattcagtctcagtagttacggcatgagttgggtccgccaggctccagggaagggtctggagtgggtctcatccattactgccggcagtagttacataaattacgctgactcagtgaagggccggttcaccatctccagagacaacgccaagagttcactgttcctgcaaatgaccagcctgagagtcgaggacacggctgtttatttctgtgtgagagaggcgtatgccagctcgtcggccctttactggttcgacccctggggccagggaaccctggtcaccgtctcctca

SEQ ID NO: 1666 - protein, 123 aa, Artificial Sequence
  Description of Artificial Sequence: Synthetic heavy chain variable region
EVQLVESGGGLVRPGGSLRLSCAASGFSLSSYGMSWVRQAPGKGLEWVSSITAGSSYINYADSVKGRFTISRDNAKSSLFLQMTSLRVEDTAVYFCVREAYASSSALYWFDPWGQGTLVTVSS

SEQ ID NO: 1667 - protein, 9 aa, Artificial Sequence
  Description of Artificial Sequence: Synthetic heavy chain variable region CDR H1
FSLSSYGMS

SEQ ID NO: 1668 - DNA, 27 bp, Artificial Sequence
  Description of Artificial Sequence: Synthetic heavy chain variable region CDR H1
ttcagtctcagtagttacggcatgagt

SEQ ID NO: 1669 - protein, 17 aa, Artificial Sequence
  Description of Artificial Sequence: Synthetic heavy chain variable region CDR H2
SITAGSSYINYADSVKG

SEQ ID NO: 1670 - DNA, 51 bp, Artificial Sequence
  Description of Artificial Sequence: Synthetic heavy chain variable region CDR H2
tccattactgccggcagtagttacataaattacgctgactcagtgaagggc

SEQ ID NO: 1671 - protein, 16 aa, Artificial Sequence
  Description of Artificial Sequence: Synthetic heavy chain variable region CDR H3
VREAYASSSALYWFDP

SEQ ID NO: 1672 - DNA, 48 bp, Artificial Sequence
  Description of Artificial Sequence: Synthetic heavy chain variable region CDR H3
gtgagagaggcgtatgccagctcgtcggccctttactggttcgacccc

SEQ ID NO: 1673 - DNA, 333 bp, Artificial Sequence
  Description of Artificial Sequence: Synthetic light chain variable region
cagtctgtcctgacgcagccgccctcagtctctggggccccagggcagagggtcaccatctcctgcactgggagcagctccaatctcggggcgggttatgttgttcactggtaccagcaacttccaggaacatcccccaaactcctcatctatggtaacaccgatcggccctcaggggtccccgaccgattctctggctccaagtctggcacctcagcctccctggccatcagtgggctccaggctgaggatgaggctgattattactgccagtcctatgacagtagcctgagtggctgggtgttcggcggagggaccaagctgaccgtccta

SEQ ID NO: 1674 - protein, 111 aa, Artificial Sequence
  Description of Artificial Sequence: Synthetic light chain variable region
QSVLTQPPSVSGAPGQRVTISCTGSSSNLGAGYVVHWYQQLPGTSPKLLIYGNTDRPSGVPDRFSGSKSGTSASLAISGLQAEDEADYYCQSYDSSLSGWVFGGGTKLTVL

SEQ ID NO: 1675 - protein, 14 aa, Artificial Sequence
  Description of Artificial Sequence: Synthetic light chain variable region CDR L1
TGSSSNLGAGYVVH

SEQ ID NO: 1676 - DNA, 42 bp, Artificial Sequence
  Description of Artificial Sequence: Synthetic light chain variable region CDR L1
actgggagcagctccaatctcggggcgggttatgttgttcac

SEQ ID NO: 1677 - protein, 7 aa, Artificial Sequence
  Description of Artificial Sequence: Synthetic light chain variable region CDR L2
GNTDRPS

SEQ ID NO: 1678 - DNA, 21 bp, Artificial Sequence
  Description of Artificial Sequence: Synthetic light chain variable region CDR L2
ggtaacaccgatcggccctca

SEQ ID NO: 1679 - protein, 11 aa, Artificial Sequence
  Description of Artificial Sequence: Synthetic light chain variable region CDR L3
QSYDSSLSGWV

SEQ ID NO: 1680 - DNA, 33 bp, Artificial Sequence
  Description of Artificial Sequence: Synthetic light chain variable region CDR L3
cagtcctatgacagtagcctgagtggctgggtg

SEQ ID NO: 1681 - DNA, 393 bp, Artificial Sequence
  Description of Artificial Sequence: Synthetic heavy chain variable region
gaggtgcagctggtggagtctgggggaggcttagtacagcctggggggtccctgcgactctcctgtgcagcctctggattcagcttcaatacctatagcatgaactgggtccgccaggctccagggaagggattggagtggctttcattcattagtagtagtagtcataccctatactacgcagactctgtgaagggccgattcaccgtcttcagagacaatgccaagcactcgctctttctgcaaatgaacggcctgagagacgaggacacggctgtttatttctgtgcgagatcccttggttcggggaattatgataacgaagatcagacattttactactactacggtatggacgtctggggccaagggaccacggtcaccgtctcctca

SEQ ID NO: 1682 - protein, 131 aa, Artificial Sequence
  Description of Artificial Sequence: Synthetic heavy chain variable region
EVQLVESGGGLVQPGGSLRLSCAASGFSFNTYSMNWVRQAPGKGLEWLSFISSSSHTLYYADSVKGRFTVFRDNAKHSLFLQMNGLRDEDTAVYFCARSLGSGNYDNEDQTFYYYYGMDVWGQGTTVTVSS

SEQ ID NO: 1683 - protein, 9 aa, Artificial Sequence
  Description of Artificial Sequence: Synthetic heavy chain variable region CDR H1
FSFNTYSMN

SEQ ID NO: 1684 - DNA, 27 bp, Artificial Sequence
  Description of Artificial Sequence: Synthetic heavy chain variable region CDR H1
ttcagcttcaatacctatagcatgaac

SEQ ID NO: 1685 - protein, 17 aa, Artificial Sequence
  Description of Artificial Sequence: Synthetic heavy chain variable region CDR H2
FISSSSHTLYYADSVKG

SEQ ID NO: 1686 - DNA, 51 bp, Artificial Sequence
  Description of Artificial Sequence: Synthetic heavy chain variable region CDR H2
ttcattagtagtagtagtcataccctatactacgcagactctgtgaagggc

SEQ ID NO: 1687 - protein, 24 aa, Artificial Sequence
  Description of Artificial Sequence: Synthetic heavy chain variable region CDR H3
ARSLGSGNYDNEDQTFYYYYGMDV

SEQ ID NO: 1688 - DNA, 72 bp, Artificial Sequence
  Description of Artificial Sequence: Synthetic heavy chain variable region CDR H3
gcgagatcccttggttcggggaattatgataacgaagatcagacattttactactactacggtatggacgtc

SEQ ID NO: 1689 - DNA, 339 bp, Artificial Sequence
  Description of Artificial Sequence: Synthetic light chain variable region
gaaacgacactcacgcagtctccactctccctgcccgtcacccctggagagccggcctccatatcctgccggtctagtcagagcctcctgtttcatagtaatggacacaattatttggattggtacctgcagaagccagggcagtctccacaactcctgatccatttgggttctaatcgggcctccggagtccctgacaggttcagtggcagtggatcaggcacagattttacactgaaaatcagcagagtggagcctgaggatgttggggtttattactgtatgcaagctctacaaactccgtacacttttggccaggggaccaaggtggagatcaaa

SEQ ID NO: 1690 - protein, 113 aa, Artificial Sequence
  Description of Artificial Sequence: Synthetic light chain variable region
ETTLTQSPLSLPVTPGEPASISCRSSQSLLFHSNGHNYLDWYLQKPGQSPQLLIHLGSNRASGVPDRFSGSGSGTDFTLKISRVEPEDVGVYYCMQALQTPYTFGQGTKVEIK

SEQ ID NO: 1691 - protein, 17 aa, Artificial Sequence
  Description of Artificial Sequence: Synthetic light chain variable region CDR L1
RSSQSLLFHSNGHNYLD

SEQ ID NO: 1692 - DNA, 51 bp, Artificial Sequence
  Description of Artificial Sequence: Synthetic light chain variable region CDR L1
cggtctagtcagagcctcctgtttcatagtaatggacacaattatttggat

SEQ ID NO: 1693 - protein, 7 aa, Artificial Sequence
  Description of Artificial Sequence: Synthetic light chain variable region CDR L2
LGSNRAS

SEQ ID NO: 1694 - DNA, 21 bp, Artificial Sequence
  Description of Artificial Sequence: Synthetic light chain variable region CDR L2
ttgggttctaatcgggcctcc

SEQ ID NO: 1695 - protein, 9 aa, Artificial Sequence
  Description of Artificial Sequence: Synthetic light chain variable region CDR L3
MQALQTPYT

SEQ ID NO: 1696 - DNA, 27 bp, Artificial Sequence
  Description of Artificial Sequence: Synthetic light chain variable region CDR L3
atgcaagctctacaaactccgtacact

SEQ ID NO: 1697 - DNA, 372 bp, Artificial Sequence; identical to SEQ ID NO: 1009
  Description of Artificial Sequence: Synthetic heavy chain variable region

SEQ ID NO: 1698 - protein, 124 aa, Artificial Sequence; identical to SEQ ID NO: 1010
  Description of Artificial Sequence: Synthetic heavy chain variable region

SEQ ID NO: 1699 - protein, 11 aa, Artificial Sequence
  Description of Artificial Sequence: Synthetic heavy chain variable region CDR H1
VSVTINDYYWT

SEQ ID NO: 1700 - DNA, 33 bp, Artificial Sequence; identical to SEQ ID NO: 1012
  Description of Artificial Sequence: Synthetic heavy chain variable region CDR H1

SEQ ID NO: 1701 - protein, 16 aa, Artificial Sequence
  Description of Artificial Sequence: Synthetic heavy chain variable region CDR H2
NIYNSGSTYQNPSLQS

SEQ ID NO: 1702 - DNA, 48 bp, Artificial Sequence; identical to SEQ ID NO: 1014
  Description of Artificial Sequence: Synthetic heavy chain variable region CDR H2

SEQ ID NO: 1703 - protein, 16 aa, Artificial Sequence
  Description of Artificial Sequence: Synthetic heavy chain variable region CDR H3
ARDLGTANNYYFGMDV

SEQ ID NO: 1704 - DNA, 48 bp, Artificial Sequence; identical to SEQ ID NO: 1016
  Description of Artificial Sequence: Synthetic heavy chain variable region CDR H3

SEQ ID NO: 1705 - DNA, 324 bp, Artificial Sequence
  Description of Artificial Sequence: Synthetic light chain variable region
gatattgtgctgacgcagtctccagccaccctgtctttgtctccaggggaaagagccactctctcctgcagggccagtcagagtgttagcacctacttagcctggtaccaacagaaacctggccaggctcccaggctcctcatctataatggatccaacagggtcactggcaccccagccaggttcagtggcagtgggtctgggacagacttcactctcaccatcagcagcgtagagcctgaagattttgcagtttattactgtcagcagcgtagcaactggcctccgtacacttttggccaggggaccaaggtggagatcaaa

SEQ ID NO: 1706 - protein, 108 aa, Artificial Sequence
  Description of Artificial Sequence: Synthetic light chain variable region
DIVLTQSPATLSLSPGERATLSCRASQSVSTYLAWYQQKPGQAPRLLIYNGSNRVTGTPARFSGSGSGTDFTLTISSVEPEDFAVYYCQQRSNWPPYTFGQGTKVEIK

SEQ ID NO: 1707 - protein, 11 aa, Artificial Sequence
  Description of Artificial Sequence: Synthetic light chain variable region CDR L1
RASQSVSTYLA

SEQ ID NO: 1708 - DNA, 33 bp, Artificial Sequence; identical to SEQ ID NO: 1020
  Description of Artificial Sequence: Synthetic light chain variable region CDR L1

SEQ ID NO: 1709 - protein, 7 aa, Artificial Sequence
  Description of Artificial Sequence: Synthetic light chain variable region CDR L2
NGSNRVT

SEQ ID NO: 1710 - DNA, 21 bp, Artificial Sequence
  Description of Artificial Sequence: Synthetic light chain variable region CDR L2
aatggatccaacagggtcact

SEQ ID NO: 1711 - protein, 10 aa, Artificial Sequence
  Description of Artificial Sequence: Synthetic light chain variable region CDR L3
QQRSNWPPYT

SEQ ID NO: 1712 - DNA, 30 bp, Artificial Sequence; identical to SEQ ID NO: 1024
  Description of Artificial Sequence: Synthetic light chain variable region CDR L3

SEQ ID NO: 1713 - DNA, 369 bp, Artificial Sequence
  Description of Artificial Sequence: Synthetic heavy chain variable region
gaggtgcagctggtggagtcgggccctggactggtgaagccttcagagaccctgtccctcagttgcattgtctctggtgactccatcaccagtaatgattactactggagttggatccgccagtccccagggaagggcctggagtggattgggtacatctatcacagcggggccaccttctacactccgtccctacggagtcgagtgaccatatcgacagacaggtccaagaaccagttctccctgagactgtcgtctgtgaccgccgcagacacggccgtatattattgtgccagtggacctgtggggatggctacaagcaactggttcgacccctggggccagggaaccctggtcaccgtctcttca

SEQ ID NO: 1714 - protein, 123 aa, Artificial Sequence
  Description of Artificial Sequence: Synthetic heavy chain variable region
EVQLVESGPGLVKPSETLSLSCIVSGDSITSNDYYWSWIRQSPGKGLEWIGYIYHSGATFYTPSLRSRVTISTDRSKNQFSLRLSSVTAADTAVYYCASGPVGMATSNWFDPWGQGTLVTVSS

SEQ ID NO: 1715 - protein, 11 aa, Artificial Sequence
  Description of Artificial Sequence: Synthetic heavy chain variable region CDR H1
DSITSNDYYWS

SEQ ID NO: 1716 - DNA, 33 bp, Artificial Sequence
  Description of Artificial Sequence: Synthetic heavy chain variable region CDR H1
gactccatcaccagtaatgattactactggagt

SEQ ID NO: 1717 - protein, 16 aa, Artificial Sequence
  Description of Artificial Sequence: Synthetic heavy chain variable region CDR H2
YIYHSGATFYTPSLRS

SEQ ID NO: 1718 - DNA, 48 bp, Artificial Sequence
  Description of Artificial Sequence: Synthetic heavy chain variable region CDR H2
tacatctatcacagcggggccaccttctacactccgtccctacggagt

SEQ ID NO: 1719 - protein, 15 aa, Artificial Sequence
  Description of Artificial Sequence: Synthetic heavy chain variable region CDR H3
ASGPVGMATSNWFDP

SEQ ID NO: 1720 - DNA, 45 bp, Artificial Sequence
  Description of Artificial Sequence: Synthetic heavy chain variable region CDR H3
gccagtggacctgtggggatggctacaagcaactggttcgacccc

SEQ ID NO: 1721 - DNA, 327 bp, Artificial Sequence
  Description of Artificial Sequence: Synthetic light chain variable region
cagcctgtgctgactcagccaccctcagtgtcagtcgccccgggaaagacggccactcttacgtgtgggggagacatcattagaactaacagtgtgaactggtaccagcagaagccaggccaggcccctgtattgatcatatattatgatagcgaccggccctcagggatccctgggcgattctctgcctccaactctgggagcgcggccaccctgaccatcagcagggtcgaagccggggatgaggccgactattactgtcaggtgtgggacagcagtactgattatcacgtggttttcggcggagggaccaagctcaccgtccta

SEQ ID NO: 1722 - protein, 109 aa, Artificial Sequence
  Description of Artificial Sequence: Synthetic light chain variable region
QPVLTQPPSVSVAPGKTATLTCGGDIIRTNSVNWYQQKPGQAPVLIIYYDSDRPSGIPGRFSASNSGSAATLTISRVEAGDEADYYCQVWDSSTDYHVVFGGGTKLTVL

SEQ ID NO: 1723 - protein, 11 aa, Artificial Sequence
  Description of Artificial Sequence: Synthetic light chain variable region CDR L1
GGDIIRTNSVN

SEQ ID NO: 1724 - DNA, 33 bp, Artificial Sequence
  Description of Artificial Sequence: Synthetic light chain variable region CDR L1
gggggagacatcattagaactaacagtgtgaac

SEQ ID NO: 1725 - protein, 7 aa, Artificial Sequence
  Description of Artificial Sequence: Synthetic light chain variable region CDR L2
YDSDRPS

SEQ ID NO: 1726 - DNA, 21 bp, Artificial Sequence
  Description of Artificial Sequence: Synthetic light chain variable region CDR L2
tatgatagcgaccggccctca

SEQ ID NO: 1727 - protein, 12 aa, Artificial Sequence
  Description of Artificial Sequence: Synthetic light chain variable region CDR L3
QVWDSSTDYHVV

SEQ ID NO: 1728 - DNA, 36 bp, Artificial Sequence
  Description of Artificial Sequence: Synthetic light chain variable region CDR L3
caggtgtgggacagcagtactgattatcacgtggtt

SEQ ID NO: 1729 - DNA, 390 bp, Artificial Sequence
  Description of Artificial Sequence: Synthetic heavy chain variable region
caggtccagctggtacagtctggggctgaggtgaagaagcctggggcctcagtgaaggtttcctgcaaggcatctggatacatcttcaccggttattttatacactgggtgcgacaggcccccggacaagggcttgagtggatgggagtaatcaatcccagaggtggaagcacaagctacgcacaaaagttccagggcagagtcgctgtgtccagggacacgtccacgactacagtctacatggagctgaacagcctgagatctgaggacacggccgtatattactgtgcgagagccccgagccacgatgagtgggtcgcaatttcccgaaataacgatgttgtggggttcgacgcctggggccagggaaccctggtcaccgtctcctca

SEQ ID NO: 1730 - protein, 130 aa, Artificial Sequence
  Description of Artificial Sequence: Synthetic heavy chain variable region
QVQLVQSGAEVKKPGASVKVSCKASGYIFTGYFIHWVRQAPGQGLEWMGVINPRGGSTSYAQKFQGRVAVSRDTSTTTVYMELNSLRSEDTAVYYCARAPSHDEWVAISRNNDVVGFDAWGQGTLVTVSS

SEQ ID NO: 1731 - protein, 9 aa, Artificial Sequence
  Description of Artificial Sequence: Synthetic heavy chain variable region CDR H1
YIFTGYFIH

SEQ ID NO: 1732 - DNA, 27 bp, Artificial Sequence
  Description of Artificial Sequence: Synthetic heavy chain variable region CDR H1
tacatcttcaccggttattttatacac

SEQ ID NO: 1733 - protein, 17 aa, Artificial Sequence
  Description of Artificial Sequence: Synthetic heavy chain variable region CDR H2
VINPRGGSTSYAQKFQG

SEQ ID NO: 1734 - DNA, 51 bp, Artificial Sequence
  Description of Artificial Sequence: Synthetic heavy chain variable region CDR H2
gtaatcaatcccagaggtggaagcacaagctacgcacaaaagttccagggc

SEQ ID NO: 1735 - protein, 23 aa, Artificial Sequence
  Description of Artificial Sequence: Synthetic heavy chain variable region CDR H3
ARAPSHDEWVAISRNNDVVGFDA

SEQ ID NO: 1736 - DNA, 69 bp, Artificial Sequence
  Description of Artificial Sequence: Synthetic heavy chain variable region CDR H3
gcgagagccccgagccacgatgagtgggtcgcaatttcccgaaataacgatgttgtggggttcgacgcc

SEQ ID NO: 1737 - DNA, 333 bp, Artificial Sequence
  Description of Artificial Sequence: Synthetic light chain variable region
cagtctgtcctgactcagccgccctcagtgtctggggccccagggcagagggtcaccatctcctgcactgggggcagctccaacatcggggcagattatgacgtacactggtaccagcagcctccaggaacagcccccaaactcctcatatttgctaacaacaatcgaccctcaggggtccctggccgattctctggctccaagtctggcacctcagcctccctggccatcactgggctccaggctgaggatgaggctgattattactgccagtcctatgacagcagcctgagtgcttgggtgttcggcggggggaccaagctgaccgtccta

SEQ ID NO: 1738 - protein, 111 aa, Artificial Sequence
  Description of Artificial Sequence: Synthetic light chain variable region
QSVLTQPPSVSGAPGQRVTISCTGGSSNIGADYDVHWYQQPPGTAPKLLIFANNNRPSGVPGRFSGSKSGTSASLAITGLQAEDEADYYCQSYDSSLSAWVFGGGTKLTVL

SEQ ID NO: 1739 - protein, 14 aa, Artificial Sequence
  Description of Artificial Sequence: Synthetic light chain variable region CDR L1
TGGSSNIGADYDVH

SEQ ID NO: 1740 - DNA, 42 bp, Artificial Sequence
  Description of Artificial Sequence: Synthetic light chain variable region CDR L1
actgggggcagctccaacatcggggcagattatgacgtacac

SEQ ID NO: 1741 - protein, 7 aa, Artificial Sequence
  Description of Artificial Sequence: Synthetic light chain variable region CDR L2
ANNNRPS

SEQ ID NO: 1742 - DNA, 21 bp, Artificial Sequence
  Description of Artificial Sequence: Synthetic light chain variable region CDR L2
gctaacaacaatcgaccctca

SEQ ID NO: 1743 - protein, 11 aa, Artificial Sequence
  Description of Artificial Sequence: Synthetic light chain variable region CDR L3
QSYDSSLSAWV

SEQ ID NO: 1744 - DNA, 33 bp, Artificial Sequence
  Description of Artificial Sequence: Synthetic light chain variable region CDR L3
cagtcctatgacagcagcctgagtgcttgggtg

SEQ ID NO: 1745 - DNA, 372 bp, Artificial Sequence
  Description of Artificial Sequence: Synthetic heavy chain variable region
gaggtgcagctggtggagtctgggggaggcctggtcaagcctggggggtccctgagactctcctgtgcagcctctggattcaccctcagtagttatgccatgaactgggtccgccaggctccagggaagggtctggagtgggtctcatccattagtgctggaagtagttacatcgactacgcagactcagtgaagggccgattcaccatctccagagacaacgccaagaactctctgtatctgcaaatgaacaacctgagagccgaggacacggctctgtattactgtgcgagagaagttttaccagcaaccgctataggaggcgcctggctcgacccctggggccagggaaccctggtcactgtctcctca

SEQ ID NO: 1746 - protein, 124 aa, Artificial Sequence
  Description of Artificial Sequence: Synthetic heavy chain variable region
EVQLVESGGGLVKPGGSLRLSCAASGFTLSSYAMNWVRQAPGKGLEWVSSISAGSSYIDYADSVKGRFTISRDNAKNSLYLQMNNLRAEDTALYYCAREVLPATAIGGAWLDPWGQGTLVTVSS

SEQ ID NO: 1747 - protein, 9 aa, Artificial Sequence
  Description of Artificial Sequence: Synthetic heavy chain variable region CDR H1
FTLSSYAMN

SEQ ID NO: 1748 - DNA, 27 bp, Artificial Sequence
  Description of Artificial Sequence: Synthetic heavy chain variable region CDR H1
ttcaccctcagtagttatgccatgaac

SEQ ID NO: 1749 - protein, 17 aa, Artificial Sequence
  Description of Artificial Sequence: Synthetic heavy chain variable region CDR H2
SISAGSSYIDYADSVKG

SEQ ID NO: 1750 - DNA, 51 bp, Artificial Sequence
  Description of Artificial Sequence: Synthetic heavy chain variable region CDR H2
tccattagtgctggaagtagttacatcgactacgcagactcagtgaagggc

SEQ ID NO: 1751 - protein, 17 aa, Artificial Sequence
  Description of Artificial Sequence: Synthetic heavy chain variable region CDR H3
AREVLPATAIGGAWLDP

SEQ ID NO: 1752 - DNA, 51 bp, Artificial Sequence
  Description of Artificial Sequence: Synthetic heavy chain variable region CDR H3
gcgagagaagttttaccagcaaccgctataggaggcgcctggctcgacccc

SEQ ID NO: 1753 - DNA, 336 bp, Artificial Sequence
  Description of Artificial Sequence: Synthetic light chain variable region
cagtctgtcctgacgcagccgccctcagtgtctggggccccagggcagacggtcaccatctcctgcactgggagcagctccaacatcggggctggatatgatgtccactggtaccggcagcttccaggaacagcccccaaactcctcatctattctaacaacaatcggccctcaggggtccctgaccgattctctggctccaagtctgacacctcagcctccctggccatcactgggctccaggctggggatgaggctgattattactgccagtcctatgacatcagcctgagtgcctcttatgtcttcggaactgggaccaaggtcaccgtccta

SEQ ID NO: 1754 - protein, 112 aa, Artificial Sequence
  Description of Artificial Sequence: Synthetic light chain variable region
QSVLTQPPSVSGAPGQTVTISCTGSSSNIGAGYDVHWYRQLPGTAPKLLIYSNNNRPSGVPDRFSGSKSDTSASLAITGLQAGDEADYYCQSYDISLSASYVFGTGTKVTVL

SEQ ID NO: 1755 - protein, 14 aa, Artificial Sequence
  Description of Artificial Sequence: Synthetic light chain variable region CDR L1
TGSSSNIGAGYDVH

SEQ ID NO: 1756 - DNA, 42 bp, Artificial Sequence
  Description of Artificial Sequence: Synthetic light chain variable region CDR L1
actgggagcagctccaacatcggggctggatatgatgtccac

SEQ ID NO: 1757 - protein, 7 aa, Artificial Sequence
  Description of Artificial Sequence: Synthetic light chain variable region CDR L2
SNNNRPS

SEQ ID NO: 1758 - DNA, 21 bp, Artificial Sequence
  Description of Artificial Sequence: Synthetic light chain variable region CDR L2
tctaacaacaatcggccctca

SEQ ID NO: 1759 - protein, 12 aa, Artificial Sequence
  Description of Artificial Sequence: Synthetic light chain variable region CDR L3
QSYDISLSASYV

SEQ ID NO: 1760 - DNA, 36 bp, Artificial Sequence
  Description of Artificial Sequence: Synthetic light chain variable region CDR L3
cagtcctatgacatcagcctgagtgcctcttatgtc

SEQ ID NO: 1761 - DNA, 369 bp, Artificial Sequence
  Description of Artificial Sequence: Synthetic heavy chain variable region
caggtccagctggtgcagtctggagctgaggtgaagaagcctggggcctcagtgaaggtctcctgcaaggcttctggttacacctttaccaactatggtttcagctgggtgcgacaggcccctggacaagggcttgagtggatgggatggatcctcactcacaatggttacacaaactatgcacagaagttccaggacagagtcaccatgaagacagacacatccacgagcacagtctacatggagctgaggagcctgagatctgtcgacacggccgtgtattactgtgcgagaattggccatgttacagccgtggctggtgcccctcctgactactggggccagggaaccctggtcaccgtctcctca

SEQ ID NO: 1762 - protein, 123 aa, Artificial Sequence
  Description of Artificial Sequence: Synthetic heavy chain variable region
QVQLVQSGAEVKKPGASVKVSCKASGYTFTNYGFSWVRQAPGQGLEWMGWILTHNGYTNYAQKFQDRVTMKTDTSTSTVYMELRSLRSVDTAVYYCARIGHVTAVAGAPPDYWGQGTLVTVSS

SEQ ID NO: 1763 - protein, 9 aa, Artificial Sequence
  Description of Artificial Sequence: Synthetic heavy chain variable region CDR H1
YTFTNYGFS

SEQ ID NO: 1764 - DNA, 27 bp, Artificial Sequence
  Description of Artificial Sequence: Synthetic heavy chain variable region CDR H1
tacacctttaccaactatggtttcagc

SEQ ID NO: 1765 - protein, 17 aa, Artificial Sequence
  Description of Artificial Sequence: Synthetic heavy chain variable region CDR H2
WILTHNGYTNYAQKFQD

SEQ ID NO: 1766 - DNA, 51 bp, Artificial Sequence
  Description of Artificial Sequence: Synthetic heavy chain variable region CDR H2
tggatcctcactcacaatggttacacaaactatgcacagaagttccaggac

SEQ ID NO: 1767 - protein, 16 aa, Artificial Sequence
  Description of Artificial Sequence: Synthetic heavy chain variable region CDR H3
ARIGHVTAVAGAPPDY

SEQ ID NO: 1768 - DNA, 48 bp, Artificial Sequence
  Description of Artificial Sequence: Synthetic heavy chain variable region CDR H3
gcgagaattggccatgttacagccgtggctggtgcccctcctgactac

SEQ ID NO: 1769 - DNA, 330 bp, Artificial Sequence
  Description of Artificial Sequence: Synthetic light chain variable region
cagcctgtgctgactcagcctgcctccgtgtctgggtatcaaggacagtcgatcaccatctcctgcagtggaaccagcagtgatgttgggacttataaccttgtctcctggtaccaacaacacccaggcaaagcccccgaactcatgatttatgagggcagtaagcggccctcaggggtttctgatcgcttctctggctccaagtctggcaacacggcctccctgacaatctctgggctccaggctgaggacgaggctgattattactgctgctcatatgtagctggtagtacttcagtattcggcggagggaccaagctcaccgtccta

SEQ ID NO: 1770 - protein, 110 aa, Artificial Sequence
  Description of Artificial Sequence: Synthetic light chain variable region
QPVLTQPASVSGYQGQSITISCSGTSSDVGTYNLVSWYQQHPGKAPELMIYEGSKRPSGVSDRFSGSKSGNTASLTISGLQAEDEADYYCCSYVAGSTSVFGGGTKLTVL

SEQ ID NO: 1771 - protein, 14 aa, Artificial Sequence
  Description of Artificial Sequence: Synthetic light chain variable region CDR L1
SGTSSDVGTYNLVS

SEQ ID NO: 1772 - DNA, 42 bp, Artificial Sequence
  Description of Artificial Sequence: Synthetic light chain variable region CDR L1
agtggaaccagcagtgatgttgggacttataaccttgtctcc

SEQ ID NO: 1773 - protein, 7 aa, Artificial Sequence
  Description of Artificial Sequence: Synthetic light chain variable region CDR L2
EGSKRPS

SEQ ID NO: 1774 - DNA, 21 bp, Artificial Sequence
  Description of Artificial Sequence: Synthetic light chain variable region CDR L2
gagggcagtaagcggccctca

SEQ ID NO: 1775 - protein, 10 aa, Artificial Sequence
  Description of Artificial Sequence: Synthetic light chain variable region CDR L3
CSYVAGSTSV

SEQ ID NO: 1776 - DNA, 30 bp, Artificial Sequence
  Description of Artificial Sequence: Synthetic light chain variable region CDR L3
tgctcatatgtagctggtagtacttcagta

SEQ ID NO: 1777 - DNA, 369 bp, Artificial Sequence
  Description of Artificial Sequence: Synthetic heavy chain variable region
gaggtgcagctggtggagtcgggccctggactggtgaagccttcagagaccctgtccctcagttgcattgtctctggtggctccatcaccagtggtgattactactggagttggctccgccagtccccagggaagggcctggagtggattgggtacatatatcacagcggggccaccttctacaccccgtccctacggagtcgagtgaccatttcgacagacacctccaagaaccaattctccctgagactgtcgtctgtgaccgccgcagacacggccgtttattattgtgccagtggacctgtcgggatggctacaagcaactggttcgacccctggggccagggaaccctggtcaccgtctcctca

SEQ ID NO: 1778 - protein, 123 aa, Artificial Sequence
  Description of Artificial Sequence: Synthetic heavy chain variable region
EVQLVESGPGLVKPSETLSLSCIVSGGSITSGDYYWSWLRQSPGKGLEWIGYIYHSGATFYTPSLRSRVTISTDTSKNQFSLRLSSVTAADTAVYYCASGPVGMATSNWFDPWGQGTLVTVSS

SEQ ID NO: 1779 - protein, 11 aa, Artificial Sequence
  Description of Artificial Sequence: Synthetic heavy chain variable region CDR H1
GSITSGDYYWS

SEQ ID NO: 1780 - DNA, 33 bp, Artificial Sequence
  Description of Artificial Sequence: Synthetic heavy chain variable region CDR H1
ggctccatcaccagtggtgattactactggagt

SEQ ID NO: 1781 - protein, 16 aa, Artificial Sequence
  Description of Artificial Sequence: Synthetic heavy chain variable region CDR H2
YIYHSGATFYTPSLRS

SEQ ID NO: 1782 - DNA, 48 bp, Artificial Sequence
  Description of Artificial Sequence: Synthetic heavy chain variable region CDR H2
tacatatatcacagcggggccaccttctacaccccgtccctacggagt

SEQ ID NO: 1783 - protein, 15 aa, Artificial Sequence
  Description of Artificial Sequence: Synthetic heavy chain variable region CDR H3
ASGPVGMATSNWFDP

SEQ ID NO: 1784 - DNA, 45 bp, Artificial Sequence
  Description of Artificial Sequence: Synthetic heavy chain variable region CDR H3
gccagtggacctgtcgggatggctacaagcaactggttcgacccc

SEQ ID NO: 1785 - DNA, 327 bp, Artificial Sequence
  Description of Artificial Sequence: Synthetic light chain variable region
tcctatgagctgacacagccaccctcagtatcagtcgccccgggaaagacggccaccattacgtgtgggggagacatcattagaactaacagtgtgaactggtaccagcagaagccaggccaggcccctctattgctcatctattatgatagcgaccggccctcagggatccctgagcgattctctgcctccaactctgggaacacggccaccctgaccatcagcagggtcgaggccggggatgaggccgactattactgtcaggtgtgggacagtggtactgattatcacgtggttttcggcggagggaccaagctgaccgtccaa

SEQ ID NO: 1786 - protein, 109 aa, Artificial Sequence
  Description of Artificial Sequence: Synthetic light chain variable region
SYELTQPPSVSVAPGKTATITCGGDIIRTNSVNWYQQKPGQAPLLLIYYDSDRPSGIPERFSASNSGNTATLTISRVEAGDEADYYCQVWDSGTDYHVVFGGGTKLTVQ

SEQ ID NO: 1787 - protein, 11 aa, Artificial Sequence
  Description of Artificial Sequence: Synthetic light chain variable region CDR L1
GGDIIRTNSVN

SEQ ID NO: 1788 - DNA, 33 bp, Artificial Sequence; identical to SEQ ID NO: 1724
  Description of Artificial Sequence: Synthetic light chain variable region CDR L1

SEQ ID NO: 1789 - protein, 7 aa, Artificial Sequence
  Description of Artificial Sequence: Synthetic light chain variable region CDR L2
YDSDRPS

SEQ ID NO: 1790 - DNA, 21 bp, Artificial Sequence
  Description of Artificial Sequence: Synthetic light chain variable region CDR L2
tatgatagcgaccggccctca

SEQ ID NO: 1791 - protein, 12 aa, Artificial Sequence
  Description of Artificial Sequence: Synthetic light chain variable region CDR L3
QVWDSGTDYHVV

SEQ ID NO: 1792 - DNA, 36 bp, Artificial Sequence
  Description of Artificial Sequence: Synthetic light chain variable region CDR L3
caggtgtgggacagtggtactgattatcacgtggtt

SEQ ID NO: 1793 - DNA, 363 bp, Artificial Sequence
  Description of Artificial Sequence: Synthetic heavy chain variable region
caggtccagctggtacagtctggggctgaggtgaagaggcctggggcctcagtgaaagtctcctgcaaggcttctgaatacgccttcaccgcccactatcttcactgggtgcgacaggcccctgatcaaggacttgagtggatgggatggatcagccctaaaagtggtggcaccaactatgcacagaagtttcacggcagggtcagcatgaccagtgacacgtccatcagtacagtctatatggaactgagcagcctgacatctgacgacacggccgtctattactgtgcgagaagcagtctggtgggagcaagccccaactttgacttctggggccagggaaccctggtcaccgtctcctca

SEQ ID NO: 1794 - protein, 121 aa, Artificial Sequence
  Description of Artificial Sequence: Synthetic heavy chain variable region
QVQLVQSGAEVKRPGASVKVSCKASEYAFTAHYLHWVRQAPDQGLEWMGWISPKSGGTNYAQKFHGRVSMTSDTSISTVYMELSSLTSDDTAVYYCARSSLVGASPNFDFWGQGTLVTVSS

SEQ ID NO: 1795 - protein, 9 aa, Artificial Sequence
  Description of Artificial Sequence: Synthetic heavy chain variable region CDR H1
YAFTAHYLH

SEQ ID NO: 1796 - DNA, 27 bp, Artificial Sequence
  Description of Artificial Sequence: Synthetic heavy chain variable region CDR H1
tacgccttcaccgcccactatcttcac

SEQ ID NO: 1797 - protein, 17 aa, Artificial Sequence
  Description of Artificial Sequence: Synthetic heavy chain variable region CDR H2
WISPKSGGTNYAQKFHG

SEQ ID NO: 1798 - DNA, 51 bp, Artificial Sequence; identical to SEQ ID NO: 390
  Description of Artificial Sequence: Synthetic heavy chain variable region CDR H2

SEQ ID NO: 1799 - protein, 14 aa, Artificial Sequence
  Description of Artificial Sequence: Synthetic heavy chain variable region CDR H3
ARSSLVGASPNFDF

SEQ ID NO: 1800 - DNA, 42 bp, Artificial Sequence; identical to SEQ ID NO: 392
  Description of Artificial Sequence: Synthetic heavy chain variable region CDR H3

SEQ ID NO: 1801 - DNA, 333 bp, Artificial Sequence
  Description of Artificial Sequence: Synthetic light chain variable region
cagtctgtggtgacgcagccgccctcagtgtctgcggccccaggacagagggtcaccatctcctgctctggaagcagctccaacattgggaataattatgtatcctggtaccagcaactcccaggatctacccccaaagtcctcatttacgacaataatcagcgaccctcagggattcctgaccgtttctctggctccaagtctggcacgtcagccaccctggccatcagcggactccagactggcgacgaggccgtctattattgcggaacatgggatgccagcctgagtgctgcaatggttttcggcggggggaccaagctcaccgtccta

SEQ ID NO: 1802 - protein, 111 aa, Artificial Sequence
  Description of Artificial Sequence: Synthetic light chain variable region
QSVVTQPPSVSAAPGQRVTISCSGSSSNIGNNYVSWYQQLPGSTPKVLIYDNNQRPSGIPDRFSGSKSGTSATLAISGLQTGDEAVYYCGTWDASLSAAMVFGGGTKLTVL

SEQ ID NO: 1803 - protein, 13 aa, Artificial Sequence
  Description of Artificial Sequence: Synthetic light chain variable region CDR L1
SGSSSNIGNNYVS

SEQ ID NO: 1804 - DNA, 39 bp, Artificial Sequence; identical to SEQ ID NO: 396
  Description of Artificial Sequence: Synthetic light chain variable region CDR L1

SEQ ID NO: 1805 - protein, 7 aa, Artificial Sequence
  Description of Artificial Sequence: Synthetic light chain variable region CDR L2
DNNQRPS

SEQ ID NO: 1806 - DNA, 21 bp, Artificial Sequence
  Description of Artificial Sequence: Synthetic light chain variable region CDR L2
gacaataatcagcgaccctca

SEQ ID NO: 1807 - protein, 12 aa, Artificial Sequence
  Description of Artificial Sequence: Synthetic light chain variable region CDR L3
GTWDASLSAAMV

SEQ ID NO: 1808 - DNA, 36 bp, Artificial Sequence
  Description of Artificial Sequence: Synthetic light chain variable region CDR L3
ggaacatgggatgccagcctgagtgctgcaatggtt

SEQ ID NO: 1809 - DNA, 366 bp, Artificial Sequence
  Description of Artificial Sequence: Synthetic heavy chain variable region
caggtgcagctacagcagtggggcgcaggactgttgaagccttcggagaccctgtccctaacctgcgctgtctctggtgggtacttcattaatgacaactggagctggatccgccagtccccagggaaggggctggagtggattggagaaattagtcatagtggaagcaccaactacaatccgtccctcaagagtcgactcaccatatcagttgacacgtccaggcagcagttttccctgaaattgagctctgtgaccgccgcggacagtggtgtttactactgtgcgcgagtccacccgtcgtatgactttggctggcgcttctttgacttctggggccagggaaccctggtcaccgtctcttca

SEQ ID NO: 1810 - protein, 122 aa, Artificial Sequence
  Description of Artificial Sequence: Synthetic heavy chain variable region
QVQLQQWGAGLLKPSETLSLTCAVSGGYFINDNWSWIRQSPGKGLEWIGEISHSGSTNYNPSLKSRLTISVDTSRQQFSLKLSSVTAADSGVYYCARVHPSYDFGWRFFDFWGQGTLVTVSS

SEQ ID NO: 1811 - protein, 9 aa, Artificial Sequence
  Description of Artificial Sequence: Synthetic heavy chain variable region CDR H1
GYFINDNWS

SEQ ID NO: 1812 - DNA, 27 bp, Artificial Sequence
  Description of Artificial Sequence: Synthetic heavy chain variable region CDR H1
gggtacttcattaatgacaactggagc

SEQ ID NO: 1813 - protein, 16 aa, Artificial Sequence
  Description of Artificial Sequence: Synthetic heavy chain variable region CDR H2
EISHSGSTNYNPSLKS

SEQ ID NO: 1814 - DNA, 48 bp, Artificial Sequence
  Description of Artificial Sequence: Synthetic heavy chain variable region CDR H2
gaaattagtcatagtggaagcaccaactacaatccgtccctcaagagt

SEQ ID NO: 1815 - protein, 16 aa, Artificial Sequence
  Description of Artificial Sequence: Synthetic heavy chain variable region CDR H3
ARVHPSYDFGWRFFDF

SEQ ID NO: 1816 - DNA, 48 bp, Artificial Sequence
  Description of Artificial Sequence: Synthetic heavy chain variable region CDR H3
gcgcgagtccacccgtcgtatgactttggctggcgcttctttgacttc

SEQ ID NO: 1817 - DNA, 324 bp, Artificial Sequence
  Description of Artificial Sequence: Synthetic light chain variable region
gaaacgacactcacgcagtctccagccaccctgtctgtgtctccaggggatacagccaccctctcctgcagggccagtcagactattagttccaacttagcctggtaccagcagaaacctggccagcctcccagtctcctcatctatggagcatccaacagggccactggtatcccagacaggtttcgtggcagtgggtctgggacagagttcactctcaccatcagcagcctgcagtctgaagattttgcagtttattactgtcagcagtatgcatactggcctccgtacacttttggccaggggaccaaggtggagatcaaa

SEQ ID NO: 1818 - protein, 108 aa, Artificial Sequence
  Description of Artificial Sequence: Synthetic light chain variable region
ETTLTQSPATLSVSPGDTATLSCRASQTISSNLAWYQQKPGQPPSLLIYGASNRATGIPDRFRGSGSGTEFTLTISSLQSEDFAVYYCQQYAYWPPYTFGQGTKVEIK

SEQ ID NO: 1819 - protein, 11 aa, Artificial Sequence
  Description of Artificial Sequence: Synthetic light chain variable region CDR L1
RASQTISSNLA

SEQ ID NO: 1820 - DNA, 33 bp, Artificial Sequence
  Description of Artificial Sequence: Synthetic light chain variable region CDR L1
agggccagtcagactattagttccaacttagcc

SEQ ID NO: 1821 - protein, 7 aa, Artificial Sequence
  Description of Artificial Sequence: Synthetic light chain variable region CDR L2
GASNRAT

SEQ ID NO: 1822 - DNA, 21 bp, Artificial Sequence
  Description of Artificial Sequence: Synthetic light chain variable region CDR L2
ggagcatccaacagggccact

SEQ ID NO: 1823 - protein, 10 aa, Artificial Sequence
  Description of Artificial Sequence: Synthetic light chain variable region CDR L3
QQYAYWPPYT

SEQ ID NO: 1824 - DNA, 30 bp, Artificial Sequence
  Description of Artificial Sequence: Synthetic light chain variable region CDR L3
cagcagtatgcatactggcctccgtacact

SEQ ID NO: 1825 - DNA, 369 bp, Artificial Sequence
  Description of Artificial Sequence: Synthetic heavy chain variable region
gaggtgcagctgttggagtcgggcccaggactggtgaagccttcacagaccctgtccctcacctgcactgtctcgggtggctccatcaacagtattgattattattggagctggatccgccagcccccagggaagggcctggagtggattggctacatttatcacagtgggagcacccactacagaccatccctcaagagtcgagtaacgatatcattagacaaggccaagaacgagttctcgctgagtctgacctctgtgactgccgcagacacggccgtgtatttctgtgccagtggccccgtcgggatggcaacaagcaactggttcgacccctggggccagggaaccctggtcaccgtctcctca

SEQ ID NO: 1826 - protein, 123 aa, Artificial Sequence
  Description of Artificial Sequence: Synthetic heavy chain variable region
EVQLLESGPGLVKPSQTLSLTCTVSGGSINSIDYYWSWIRQPPGKGLEWIGYIYHSGSTHYRPSLKSRVTISLDKAKNEFSLSLTSVTAADTAVYFCASGPVGMATSNWFDPWGQGTLVTVSS

SEQ ID NO: 1827 - protein, 11 aa, Artificial Sequence
  Description of Artificial Sequence: Synthetic heavy chain variable region CDR H1
GSINSIDYYWS

SEQ ID NO: 1828 - DNA, 33 bp, Artificial Sequence
  Description of Artificial Sequence: Synthetic heavy chain variable region CDR H1
ggctccatcaacagtattgattattattggagc

SEQ ID NO: 1829 - protein, 16 aa, Artificial Sequence
  Description of Artificial Sequence: Synthetic heavy chain variable region CDR H2
YIYHSGSTHYRPSLKS

SEQ ID NO: 1830 - DNA, 48 bp, Artificial Sequence
  Description of Artificial Sequence: Synthetic heavy chain variable region CDR H2
tacatttatcacagtgggagcacccactacagaccatccctcaagagt

SEQ ID NO: 1831 - protein, 15 aa, Artificial Sequence
  Description of Artificial Sequence: Synthetic heavy chain variable region CDR H3
ASGPVGMATSNWFDP

SEQ ID NO: 1832 - DNA, 45 bp, Artificial Sequence
  Description of Artificial Sequence: Synthetic heavy chain variable region CDR H3
gccagtggccccgtcgggatggcaacaagcaactggttcgacccc

SEQ ID NO: 1833 - DNA, 327 bp, Artificial Sequence
  Description of Artificial Sequence: Synthetic light chain variable region
cagcctgtgctgactcagccaccctcagtgtcagtgaccccaggagagacggccaggcttccctgtgagggagacatcgttgtcactaacagtgtccactggtaccagcagaagccaggccaggcccctgttttggtcgtctattatgatagcgaccgggcctcagggatccctgagcgattctctggctccaattctgggaacacggccaccctgagcatcagcagggtcgaagccggggatgaggccgactactattgtcaggtgtgggatagtagtactgatcatcatgtggtgttcggcggtgggaccaagctcaccgtccta

SEQ ID NO: 1834 - protein, 109 aa, Artificial Sequence
  Description of Artificial Sequence: Synthetic light chain variable region
QPVLTQPPSVSVTPGETARLPCEGDIVVTNSVHWYQQKPGQAPVLVVYYDSDRASGIPERFSGSNSGNTATLSISRVEAGDEADYYCQVWDSSTDHHVVFGGGTKLTVL

SEQ ID NO: 1835 - protein, 11 aa, Artificial Sequence
  Description of Artificial Sequence: Synthetic light chain variable region CDR L1
EGDIVVTNSVH

SEQ ID NO: 1836 - DNA, 33 bp, Artificial Sequence
  Description of Artificial Sequence: Synthetic light chain variable region CDR L1
gagggagacatcgttgtcactaacagtgtccac

SEQ ID NO: 1837 - protein, 7 aa, Artificial Sequence
  Description of Artificial Sequence: Synthetic light chain variable region CDR L2
YDSDRAS

SEQ ID NO: 1838 - DNA, 21 bp, Artificial Sequence
  Description of Artificial Sequence: Synthetic light chain variable region CDR L2
tatgatagcgaccgggcctca

SEQ ID NO: 1839 - protein, 12 aa, Artificial Sequence
  Description of Artificial Sequence: Synthetic light chain variable region CDR L3
QVWDSSTDHHVV

SEQ ID NO: 1840 - DNA, 36 bp, Artificial Sequence
  Description of Artificial Sequence: Synthetic light chain variable region CDR L3
caggtgtgggatagtagtactgatcatcatgtggtg

SEQ ID NO: 1841 - DNA, 372 bp, Artificial Sequence
  Description of Artificial Sequence: Synthetic heavy chain variable region
caggtccagctggtgcagtctggggctgaggtgaagaagcctgggtcctcggtgaaggtctcctgcaaggcttctggaggcagattcagcagcgacgctatcagctgggtgcgacaggcccctggacaagggcttgagtggatgggaggaatcatccctatccgtgggacaccaacctacgcacagaagttccagggcagagtcacgattatcgcggacgaatccacgactacatcctacatggagatgagcagcctgagatctgaggacacggccgtgtattactgtgcgagaccgaattacgatattttgactggttataatgatgcttttgatatttggggccaagggacaatggtcaccgtctcttca

SEQ ID NO: 1842 - protein, 124 aa, Artificial Sequence
  Description of Artificial Sequence: Synthetic heavy chain variable region
QVQLVQSGAEVKKPGSSVKVSCKASGGRFSSDAISWVRQAPGQGLEWMGGIIPIRGTPTYAQKFQGRVTIIADESTTTSYMEMSSLRSEDTAVYYCARPNYDILTGYNDAFDIWGQGTMVTVSS

SEQ ID NO: 1843 - protein, 9 aa, Artificial Sequence
  Description of Artificial Sequence: Synthetic heavy chain variable region CDR H1
GRFSSDAIS

SEQ ID NO: 1844 - DNA, 27 bp, Artificial Sequence
  Description of Artificial Sequence: Synthetic heavy chain variable region CDR H1
ggcagattcagcagcgacgctatcagc

SEQ ID NO: 1845 - protein, 17 aa, Artificial Sequence
  Description of Artificial Sequence: Synthetic heavy chain variable region CDR H2
GIIPIRGTPTYAQKFQG

SEQ ID NO: 1846 - DNA, 51 bp, Artificial Sequence
  Description of Artificial Sequence: Synthetic heavy chain variable region CDR H2
ggaatcatccctatccgtgggacaccaacctacgcacagaagttccagggc

SEQ ID NO: 1847 - protein, 17 aa, Artificial Sequence
  Description of Artificial Sequence: Synthetic heavy chain variable region CDR H3
ARPNYDILTGYNDAFDI

SEQ ID NO: 1848 - DNA, 51 bp, Artificial Sequence
  Description of Artificial Sequence: Synthetic heavy chain variable region CDR H3
gcgagaccgaattacgatattttgactggttataatgatgcttttgatatt

SEQ ID NO: 1849 - DNA, 327 bp, Artificial Sequence
  Description of Artificial Sequence: Synthetic light chain variable region
cagtctgtgttgacgcagcctcgctcagtgtccgggtctcctggacagtcagtcaccatctcctgcactggaaccagcagtgatgttggtggttataactatgtctcctggtaccaacagcacccaggcaaagtccccagactcatgatttacgatgtcagtaagcggccctcaggggcccctgatcgcttctctggctccaagtctggcaacacggcctccctgaccatctctgggctccaggctgaggatgaggctgattattactgctgctcatatgcaggcggcctttatgtcttcggaactgggaccaagctcaccgtccta

SEQ ID NO: 1850 - protein, 109 aa, Artificial Sequence
  Description of Artificial Sequence: Synthetic light chain variable region
QSVLTQPRSVSGSPGQSVTISCTGTSSDVGGYNYVSWYQQHPGKVPRLMIYDVSKRPSGAPDRFSGSKSGNTASLTISGLQAEDEADYYCCSYAGGLYVFGTGTKLTVL

SEQ ID NO: 1851 - protein, 14 aa, Artificial Sequence
  Description of Artificial Sequence: Synthetic light chain variable region CDR L1
TGTSSDVGGYNYVS

SEQ ID NO: 1852 - DNA, 42 bp, Artificial Sequence
  Description of Artificial Sequence: Synthetic light chain variable region CDR L1
actggaaccagcagtgatgttggtggttataactatgtctcc

SEQ ID NO: 1853 - protein, 7 aa, Artificial Sequence
  Description of Artificial Sequence: Synthetic light chain variable region CDR L2
DVSKRPS

SEQ ID NO: 1854 - DNA, 21 bp, Artificial Sequence
  Description of Artificial Sequence: Synthetic light chain variable region CDR L2
gatgtcagtaagcggccctca

SEQ ID NO: 1855 - protein, 9 aa, Artificial Sequence
  Description of Artificial Sequence: Synthetic light chain variable region CDR L3
CSYAGGLYV

SEQ ID NO: 1856 - DNA, 27 bp, Artificial Sequence
  Description of Artificial Sequence: Synthetic light chain variable region CDR L3
tgctcatatgcaggcggcctttatgtc

SEQ ID NO: 1857 - DNA, 378 bp, Artificial Sequence
  Description of Artificial Sequence: Synthetic heavy chain variable region
gaggtgcagctggtggagtccggggctgaggtgaagaagcctggggcctcagtgaaggtctcctgcaaggcttctggatacaccttcaccacttatgatatcaactgggtgcgacaggccactggacgggggcttgagtggatgggatggatgacccctgatagtggtagcacaggctatccacagaacttccagggcagagtcaccatgaccaggaacacctccataagcacagcctacatggagttgagcaacctgagatctgaggacacggccgtatattactgtgtgcaaatggaccattgtagaagtaccagctgctctgaggggaactggttcgacacctggggccagggaaccctggtcaccgtctcctca

SEQ ID NO: 1858 - protein, 126 aa, Artificial Sequence
  Description of Artificial Sequence: Synthetic heavy chain variable region
EVQLVESGAEVKKPGASVKVSCKASGYTFTTYDINWVRQATGRGLEWMGWMTPDSGSTGYPQNFQGRVTMTRNTSISTAYMELSNLRSEDTAVYYCVQMDHCRSTSCSEGNWFDTWGQGTLVTVSS

SEQ ID NO: 1859 - protein, 9 aa, Artificial Sequence
  Description of Artificial Sequence: Synthetic heavy chain variable region CDR H1
YTFTTYDIN

SEQ ID NO: 1860 - DNA, 27 bp, Artificial Sequence
  Description of Artificial Sequence: Synthetic heavy chain variable region CDR H1
tacaccttcaccacttatgatatcaac

SEQ ID NO: 1861 - protein, 17 aa, Artificial Sequence
  Description of Artificial Sequence: Synthetic heavy chain variable region CDR H2
WMTPDSGSTGYPQNFQG

SEQ ID NO: 1862 - DNA, 51 bp, Artificial Sequence
  Description of Artificial Sequence: Synthetic heavy chain variable region CDR H2
tggatgacccctgatagtggtagcacaggctatccacagaacttccagggc

SEQ ID NO: 1863 - protein, 19 aa, Artificial Sequence
  Description of Artificial Sequence: Synthetic heavy chain variable region CDR H3
VQMDHCRSTSCSEGNWFDT

SEQ ID NO: 1864 - DNA, 57 bp, Artificial Sequence
  Description of Artificial Sequence: Synthetic heavy chain variable region CDR H3
gtgcaaatggaccattgtagaagtaccagctgctctgaggggaactggttcgacacc

SEQ ID NO: 1865 - DNA, 330 bp, Artificial Sequence
  Description of Artificial Sequence: Synthetic light chain variable region
cagcctgggctgactcagccaccctcggtgtctgcagcccccaggcagagggtcaccatctcctgttctggaagcagctccaacatcggaactaatgctgtaaactggtaccagcagctcccaggaaaggctcccaaactcctcatctattctgataatctgatgccctcaggggtctctgcccgattctctggctccaagtctggcacctcggcctccctggccatcagtgggctccagtctgaggatgaggctgattattactgtgcagcatgggatgacagcctgaatgtttgggtgttcggcggggggaccaagctcaccgtccta

SEQ ID NO: 1866 - protein, 110 aa, Artificial Sequence
  Description of Artificial Sequence: Synthetic light chain variable region
QPGLTQPPSVSAAPRQRVTISCSGSSSNIGTNAVNWYQQLPGKAPKLLIYSDNLMPSGVSARFSGSKSGTSASLAISGLQSEDEADYYCAAWDDSLNVWVFGGGTKLTVL

SEQ ID NO: 1867 - protein, 13 aa, Artificial Sequence
  Description of Artificial Sequence: Synthetic light chain variable region CDR L1
SGSSSNIGTNAVN

SEQ ID NO: 1868 - DNA, 39 bp, Artificial Sequence
  Description of Artificial Sequence: Synthetic light chain variable region CDR L1
tctggaagcagctccaacatcggaactaatgctgtaaac

SEQ ID NO: 1869 - protein, 7 aa, Artificial Sequence
  Description of Artificial Sequence: Synthetic light chain variable region CDR L2
SDNLMPS

SEQ ID NO: 1870 - DNA, 21 bp, Artificial Sequence
  Description of Artificial Sequence: Synthetic light chain variable region CDR L2
tctgataatctgatgccctca

SEQ ID NO: 1871 - protein, 11 aa, Artificial Sequence
  Description of Artificial Sequence: Synthetic light chain variable region CDR L3
AAWDDSLNVWV

SEQ ID NO: 1872 - DNA, 33 bp, Artificial Sequence
  Description of Artificial Sequence: Synthetic light chain variable region CDR L3
gcagcatgggatgacagcctgaatgtttgggtg

SEQ ID NO: 1873 - DNA, 375 bp, Artificial Sequence
  Description of Artificial Sequence: Synthetic heavy chain variable region
gaggtgcagctggtggagtctgggggaggcttggtgaagccagggcggtccctgagactctcctgtacagcctctggattcaacttcggtgattatgctatgagctggttccgccaggctccagggaaggggctggagtgggtaggtttcattagaagcaaaacttatcgtgagacaagagaatacgccgcgtctgtgaaaggcagattcaccatgtcaagagatgatttcaacaggatcgcctatctgcaaatgaacagcctgaaaaccgaggacacagccatgtattattgtacgagacaagacgatttttggagtggtcatccctactactttgagtactggggccagggaaccctggtcaccgtctcctca

SEQ ID NO: 1874 - protein, 125 aa, Artificial Sequence
  Description of Artificial Sequence: Synthetic heavy chain variable region
EVQLVESGGGLVKPGRSLRLSCTASGFNFGDYAMSWFRQAPGKGLEWVGFIRSKTYRETREYAASVKGRFTMSRDDFNRIAYLQMNSLKTEDTAMYYCTRQDDFWSGHPYYFEYWGQGTLVTVSS

SEQ ID NO: 1875 - protein, 9 aa, Artificial Sequence
  Description of Artificial Sequence: Synthetic heavy chain variable region CDR H1
FNFGDYAMS

SEQ ID NO: 1876 - DNA, 27 bp, Artificial Sequence
  Description of Artificial Sequence: Synthetic heavy chain variable region CDR H1
ttcaacttcggtgattatgctatgagc

SEQ ID NO: 1877 - protein, 19 aa, Artificial Sequence
  Description of Artificial Sequence: Synthetic heavy chain variable region CDR H2
FIRSKTYRETREYAASVKG

SEQ ID NO: 1878 - DNA, 57 bp, Artificial Sequence
  Description of Artificial Sequence: Synthetic heavy chain variable region CDR H2
ttcattagaagcaaaacttatcgtgagacaagagaatacgccgcgtctgtgaaaggc

SEQ ID NO: 1879 - protein, 16 aa, Artificial Sequence
  Description of Artificial Sequence: Synthetic heavy chain variable region CDR H3
TRQDDFWSGHPYYFEY

SEQ ID NO: 1880 - DNA, 48 bp, Artificial Sequence
  Description of Artificial Sequence: Synthetic heavy chain variable region CDR H3
acgagacaagacgatttttggagtggtcatccctactactttgagtac

SEQ ID NO: 1881 - DNA, 333 bp, Artificial Sequence
  Description of Artificial Sequence: Synthetic light chain variable region
cagcctgtgctgactcagcccccctccgcgtccgggtctcctggacagtcagtcaccatctcctgcactggaaccaacagtgacgtgggtagttataactatgtctcctggtaccaacatcacccaggcaaagcccccaaactcatcatttatgacgtcgctaagcggccctcaggggtccctgatcgcttctctggctccaagtctggcaacacggcctccctgaccgtctctgggctccaggctgaggatgaggctgattattactgcagctcatatgcaggcagtaacgatttgggggtcttcggaactgggaccaagctcaccgtccta

SEQ ID NO: 1882 - protein, 111 aa, Artificial Sequence
  Description of Artificial Sequence: Synthetic light chain variable region
QPVLTQPPSASGSPGQSVTISCTGTNSDVGSYNYVSWYQHHPGKAPKLIIYDVAKRPSGVPDRFSGSKSGNTASLTVSGLQAEDEADYYCSSYAGSNDLGVFGTGTKLTVL

SEQ ID NO: 1883 - protein, 14 aa, Artificial Sequence
  Description of Artificial Sequence: Synthetic light chain variable region CDR L1
TGTNSDVGSYNYVS

SEQ ID NO: 1884 - DNA, 42 bp, Artificial Sequence
  Description of Artificial Sequence: Synthetic light chain variable region CDR L1
actggaaccaacagtgacgtgggtagttataactatgtctcc

SEQ ID NO: 1885 - protein, 7 aa, Artificial Sequence
  Description of Artificial Sequence: Synthetic light chain variable region CDR L2
DVAKRPS

SEQ ID NO: 1886 - DNA, 21 bp, Artificial Sequence
  Description of Artificial Sequence: Synthetic light chain variable region CDR L2
gacgtcgctaagcggccctca

SEQ ID NO: 1887 - protein, 11 aa, Artificial Sequence
  Description of Artificial Sequence: Synthetic light chain variable region CDR L3
SSYAGSNDLGV

SEQ ID NO: 1888 - DNA, 33 bp, Artificial Sequence
  Description of Artificial Sequence: Synthetic light chain variable region CDR L3
agctcatatgcaggcagtaacgatttgggggtc

SEQ ID NO: 1889 - DNA, 372 bp, Artificial Sequence
  Description of Artificial Sequence: Synthetic heavy chain variable region
gaggtgcagctggtggagtccggcccaggactggtgaagccttcggagaccctgtccctcacctgcactgtgtctggtggctccgtcagtggtcactactggagctggattcggcagttcccagggaaggaactggaatggattggtcatatctattatattgggacgaccaactacaacccctccctcaagagtcgagtcatcatatcgctagacacgtccaagaatcagctctccctgaagctgagttctgtgaccgctgcggacactgccgtttattattgtgccagacagttcggctatgataaaaatactttaagtcggcttgactttgactactggggccagggaaccctggtcaccgtctcctca

SEQ ID NO: 1890 - protein, 124 aa, Artificial Sequence
  Description of Artificial Sequence: Synthetic heavy chain variable region
EVQLVESGPGLVKPSETLSLTCTVSGGSVSGHYWSWIRQFPGKELEWIGHIYYIGTTNYNPSLKSRVIISLDTSKNQLSLKLSSVTAADTAVYYCARQFGYDKNTLSRLDFDYWGQGTLVTVSS

SEQ ID NO: 1891 - protein, 9 aa, Artificial Sequence
  Description of Artificial Sequence: Synthetic heavy chain variable region CDR H1
GSVSGHYWS

SEQ ID NO: 1892 - DNA, 27 bp, Artificial Sequence
  Description of Artificial Sequence: Synthetic heavy chain variable region CDR H1
ggctccgtcagtggtcactactggagc

SEQ ID NO: 1893 - protein, 16 aa, Artificial Sequence
  Description of Artificial Sequence: Synthetic heavy chain variable region CDR H2
HIYYIGTTNYNPSLKS

SEQ ID NO: 1894 - DNA, 48 bp, Artificial Sequence
  Description of Artificial Sequence: Synthetic heavy chain variable region CDR H2
catatctattatattgggacgaccaactacaacccctccctcaagagt

SEQ ID NO: 1895 - protein, 18 aa, Artificial Sequence
  Description of Artificial Sequence: Synthetic heavy chain variable region CDR H3
ARQFGYDKNTLSRLDFDY

SEQ ID NO: 1896 - DNA, 54 bp, Artificial Sequence
  Description of Artificial Sequence: Synthetic heavy chain variable region CDR H3
gccagacagttcggctatgataaaaatactttaagtcggcttgactttgactac

SEQ ID NO: 1897 - DNA, 321 bp, Artificial Sequence
  Description of Artificial Sequence: Synthetic light chain variable region
gacatccagatgacccagtctccatcctccctgtctgcatctgtaagagacagagtcaccatcacttgccgggcaagtcagagcattagcagctatttaaattggtatcaacagagaccagggaaagcccctaagctcctgatctattctgcattcagtttacatagtggtgtcccatcaaggttcagtggcagtggatctgagacagagttcactctcaccatcagcagtctgcaacctgacgattttgcaacttattactgtcaacagagttacagtattccctggacgttcggccaagggaccaaggtggaaatcaaa

SEQ ID NO: 1898 - protein, 107 aa, Artificial Sequence
  Description of Artificial Sequence: Synthetic light chain variable region
DIQMTQSPSSLSASVRDRVTITCRASQSISSYLNWYQQRPGKAPKLLIYSAFSLHSGVPSRFSGSGSETEFTLTISSLQPDDFATYYCQQSYSIPWTFGQGTKVEIK

SEQ ID NO: 1899 - protein, 11 aa, Artificial Sequence
  Description of Artificial Sequence: Synthetic light chain variable region CDR L1
RASQSISSYLN

SEQ ID NO: 1900 - DNA, 33 bp, Artificial Sequence
  Description of Artificial Sequence: Synthetic light chain variable region CDR L1
cgggcaagtcagagcattagcagctatttaaat

SEQ ID NO: 1901 - protein, 7 aa, Artificial Sequence
  Description of Artificial Sequence: Synthetic light chain variable region CDR L2
SAFSLHS

SEQ ID NO: 1902 - DNA, 21 bp, Artificial Sequence
  Description of Artificial Sequence: Synthetic light chain variable region CDR L2
tctgcattcagtttacatagt

SEQ ID NO: 1903 - protein, 9 aa, Artificial Sequence
  Description of Artificial Sequence: Synthetic light chain variable region CDR L3
QQSYSIPWT

SEQ ID NO: 1904 - DNA, 27 bp, Artificial Sequence
  Description of Artificial Sequence: Synthetic light chain variable region CDR L3
caacagagttacagtattccctggacg

SEQ ID NO: 1905 - DNA, 369 bp, Artificial Sequence
  Description of Artificial Sequence: Synthetic heavy chain variable region
caggtgcagctgcaggagtccggcccgggactggtgaagccttcggagaccctgtccctcacctgcagtgtctctggtggctccatcaccaatgttaattactactggggctggatccgccagccccccgggaagggcctggagtggattgggagtatctattataatggaaacacctactacaacccgtccctccagagtcgagtcaccatgtccgtggacacgtccaagaaccacttctccctgaggctgacgtctgtgaccgccgcagacacggctgtatatttttgtgcgagagaggggcctaattgggaattgttgaatgctttcgatatctggggccaagggaccacggtcaccgtctcctca

SEQ ID NO: 1906 - protein, 123 aa, Artificial Sequence; identical to SEQ ID NO: 1266
  Description of Artificial Sequence: Synthetic heavy chain variable region

SEQ ID NO: 1907 - protein, 11 aa, Artificial Sequence
  Description of Artificial Sequence: Synthetic heavy chain variable region CDR H1
GSITNVNYYWG

SEQ ID NO: 1908 - DNA, 33 bp, Artificial Sequence; identical to SEQ ID NO: 1268
  Description of Artificial Sequence: Synthetic heavy chain variable region CDR H1

SEQ ID NO: 1909 - protein, 16 aa, Artificial Sequence
  Description of Artificial Sequence: Synthetic heavy chain variable region CDR H2
SIYYNGNTYYNPSLQS

SEQ ID NO: 1910 - DNA, 48 bp, Artificial Sequence; identical to SEQ ID NO: 1270
  Description of Artificial Sequence: Synthetic heavy chain variable region CDR H2

SEQ ID NO: 1911 - protein, 15 aa, Artificial Sequence
  Description of Artificial Sequence: Synthetic heavy chain variable region CDR H3
AREGPNWELLNAFDI

SEQ ID NO: 1912 - DNA, 45 bp, Artificial Sequence; identical to SEQ ID NO: 1272
  Description of Artificial Sequence: Synthetic heavy chain variable region CDR H3

SEQ ID NO: 1913 - DNA, 324 bp, Artificial Sequence
  Description of Artificial Sequence: Synthetic light chain variable region
tcctatgagctgactcagccaccctcggtgtcagtggccccaggacagacggccaggattacctgtgggggaaacaacattggaagtaaaaatgtgcactggtaccagcagaagccaggccaggcccctgtcttggtcgtctatgaggatacccaccggccctcagggatccctgagcgattctctggctccaactctgggaacacggccaccctgaccatcagtagggtcgaagccggggatgaggccgactattactgtcaggtgtgggatactagtagtgatcatgtggtattcggcggagggaccaagctgaccgtcctc

SEQ ID NO: 1914 - protein, 108 aa, Artificial Sequence
  Description of Artificial Sequence: Synthetic light chain variable region
SYELTQPPSVSVAPGQTARITCGGNNIGSKNVHWYQQKPGQAPVLVVYEDTHRPSGIPERFSGSNSGNTATLTISRVEAGDEADYYCQVWDTSSDHVVFGGGTKLTVL

SEQ ID NO: 1915 - protein, 11 aa, Artificial Sequence
  Description of Artificial Sequence: Synthetic light chain variable region CDR L1
GGNNIGSKNVH

SEQ ID NO: 1916 - DNA, 33 bp, Artificial Sequence; identical to SEQ ID NO: 1276
  Description of Artificial Sequence: Synthetic light chain variable region CDR L1

SEQ ID NO: 1917 - protein, 7 aa, Artificial Sequence
  Description of Artificial Sequence: Synthetic light chain variable region CDR L2
EDTHRPS

SEQ ID NO: 1918 - DNA, 21 bp, Artificial Sequence
  Description of Artificial Sequence: Synthetic light chain variable region CDR L2
gaggatacccaccggccctca

SEQ ID NO: 1919 - protein, 11 aa, Artificial Sequence
  Description of Artificial Sequence: Synthetic light chain variable region CDR L3
QVWDTSSDHVV

SEQ ID NO: 1920 - DNA, 33 bp, Artificial Sequence; identical to SEQ ID NO: 1280
  Description of Artificial Sequence: Synthetic light chain variable region CDR L3

SEQ ID NO: 1921 - DNA, 363 bp, Artificial Sequence
  Description of Artificial Sequence: Synthetic heavy chain variable region
caggtccagcttgtgcagtctggggctgaggtgaagaagcctggggcctcagtgaaggtctcctgcaagacttctggttacacctttagtcatttcggtgtcacctggatacgacaggccccaggacaagggcttgagtggctgggatggatcagcgcttacaatggtaacacagactctgcagacaaactgcagggcagactcaccatgacgacagacacatccacgaacaccgcctacatggagttgaggagcctcagatctgacgacacggccgtctattactgtgcgagagatccccccgcatcagctgctgccatgcttgactactggggccagggaaccctggtcaccgtctcctca

SEQ ID NO: 1922 - protein, 121 aa, Artificial Sequence
  Description of Artificial Sequence: Synthetic heavy chain variable region
QVQLVQSGAEVKKPGASVKVSCKTSGYTFSHFGVTWIRQAPGQGLEWLGWISAYNGNTDSADKLQGRLTMTTDTSTNTAYMELRSLRSDDTAVYYCARDPPASAAAMLDYWGQGTLVTVSS

SEQ ID NO: 1923 - protein, 9 aa, Artificial Sequence
  Description of Artificial Sequence: Synthetic heavy chain variable region CDR H1
YTFSHFGVT

SEQ ID NO: 1924 - DNA, 27 bp, Artificial Sequence
  Description of Artificial Sequence: Synthetic heavy chain variable region CDR H1
tacacctttagtcatttcggtgtcacc

SEQ ID NO: 1925 - protein, 17 aa, Artificial Sequence
  Description of Artificial Sequence: Synthetic heavy chain variable region CDR H2
WISAYNGNTDSADKLQG

SEQ ID NO: 1926 - DNA, 51 bp, Artificial Sequence
  Description of Artificial Sequence: Synthetic heavy chain variable region CDR H2
tggatcagcgcttacaatggtaacacagactctgcagacaaactgcagggc

SEQ ID NO: 1927 - protein, 14 aa, Artificial Sequence
  Description of Artificial Sequence: Synthetic heavy chain variable region CDR H3
ARDPPASAAAMLDY

SEQ ID NO: 1928 - DNA, 42 bp, Artificial Sequence
  Description of Artificial Sequence: Synthetic heavy chain variable region CDR H3
gcgagagatccccccgcatcagctgctgccatgcttgactac

SEQ ID NO: 1929 - DNA, 339 bp, Artificial Sequence
  Description of Artificial Sequence: Synthetic light chain variable region
gacatccagatgacccagtctccactctccctggccgtcacccttggacagccggcctccatctcctgcaggtctagtcaaggcctcgaatacactgatggaaacacctacttgagttggtttcagcagaggccaggccaatctccaaggcgcctcatttataaggtttctaatcgggactctggggtcccagacagattcagcggcagcggggcaggcactgatttcacactgagaatcagcagggtggaggctgaggatgttggggtttattactgcatgcaaggtacacacgggcggggaatctctttcggtcctgggaccaaagtggatatcaaa

SEQ ID NO: 1930 - protein, 113 aa, Artificial Sequence
  Description of Artificial Sequence: Synthetic light chain variable region
DIQMTQSPLSLAVTLGQPASISCRSSQGLEYTDGNTYLSWFQQRPGQSPRRLIYKVSNRDSGVPDRFSGSGAGTDFTLRISRVEAEDVGVYYCMQGTHGRGISFGPGTKVDIK

SEQ ID NO: 1931 - protein, 16 aa, Artificial Sequence
  Description of Artificial Sequence: Synthetic light chain variable region CDR L1
RSSQGLEYTDGNTYLS

SEQ ID NO: 1932 - DNA, 48 bp, Artificial Sequence
  Description of Artificial Sequence: Synthetic light chain variable region CDR L1
aggtctagtcaaggcctcgaatacactgatggaaacacctacttgagt

SEQ ID NO: 1933 - protein, 7 aa, Artificial Sequence
  Description of Artificial Sequence: Synthetic light chain variable region CDR L2
KVSNRDS

SEQ ID NO: 1934 - DNA, 21 bp, Artificial Sequence
  Description of Artificial Sequence: Synthetic light chain variable region CDR L2
aaggtttctaatcgggactct

SEQ ID NO: 1935 - protein, 10 aa, Artificial Sequence
  Description of Artificial Sequence: Synthetic light chain variable region CDR L3
MQGTHGRGIS

SEQ ID NO: 1936 - DNA, 30 bp, Artificial Sequence; identical to SEQ ID NO: 784
  Description of Artificial Sequence: Synthetic light chain variable region CDR L3

SEQ ID NO: 1937 - DNA, 363 bp, Artificial Sequence
  Description of Artificial Sequence: Synthetic heavy chain variable region
caggtgcagctggtgcagtctggggctgaggtgaagaagcctggggcctcagtgagggtctcctgcaaggcctctggatacaccttcaccgactactttatgaactgggtgcgacaggcccctggagggggccttgagtggatggggtggatcaatcctctcagtggagtcacaaaatatgcacagcagtttcagggcagtgtcaccatgaccactgacacgtccatcaccacaggctacatggagctgaggagcctgagagttgacgacacggccgtctattattgtgcgagccagtcttccccttacaccccgggcgccatgggcgtctggggccaagggaccacggtcaccgtctcctca

SEQ ID NO: 1938 - protein, 121 aa, Artificial Sequence
  Description of Artificial Sequence: Synthetic heavy chain variable region
QVQLVQSGAEVKKPGASVRVSCKASGYTFTDYFMNWVRQAPGGGLEWMGWINPLSGVTKYAQQFQGSVTMTTDTSITTGYMELRSLRVDDTAVYYCASQSSPYTPGAMGVWGQGTTVTVSS

SEQ ID NO: 1939 - protein, 9 aa, Artificial Sequence
  Description of Artificial Sequence: Synthetic heavy chain variable region CDR H1
YTFTDYFMN

SEQ ID NO: 1940 - DNA, 27 bp, Artificial Sequence
  Description of Artificial Sequence: Synthetic heavy chain variable region CDR H1
tacaccttcaccgactactttatgaac

SEQ ID NO: 1941 - protein, 17 aa, Artificial Sequence
  Description of Artificial Sequence: Synthetic heavy chain variable region CDR H2
WINPLSGVTKYAQQFQG

SEQ ID NO: 1942 - DNA, 51 bp, Artificial Sequence
  Description of Artificial Sequence: Synthetic heavy chain variable region CDR H2
tggatcaatcctctcagtggagtcacaaaatatgcacagcagtttcagggc

SEQ ID NO: 1943 - protein, 14 aa, Artificial Sequence
  Description of Artificial Sequence: Synthetic heavy chain variable region CDR H3
ASQSSPYTPGAMGV

SEQ ID NO: 1944 - DNA, 42 bp, Artificial Sequence
  Description of Artificial Sequence: Synthetic heavy chain variable region CDR H3
gcgagccagtcttccccttacaccccgggcgccatgggcgtc

SEQ ID NO: 1945 - DNA, 321 bp, Artificial Sequence
  Description of Artificial Sequence: Synthetic light chain variable region
gacatccggatgacccagtctccatcctccctgtctgcatctgtaggagacagagtcaccatcacttgccggacaagtcagagcgttagcggctatttaagttggtatcagcagaaaccagggaaagcccctaagctcctgatctatgcggcatccaatttgtacagtggggtcccatcaaggttcagtggcagtggatctgggacagatttcactctcaccatcaccagtctgcaacctgaagattttgcaacttacttctgtcaactgaattccggtgccctattcactttcggccctgggaccaaggtggaaatcaaa

SEQ ID NO: 1946 - protein, 107 aa, Artificial Sequence
  Description of Artificial Sequence: Synthetic light chain variable region
DIRMTQSPSSLSASVGDRVTITCRTSQSVSGYLSWYQQKPGKAPKLLIYAASNLYSGVPSRFSGSGSGTDFTLTITSLQPEDFATYFCQLNSGALFTFGPGTKVEIK

SEQ ID NO: 1947 - protein, 11 aa, Artificial Sequence
  Description of Artificial Sequence: Synthetic light chain variable region CDR L1
RTSQSVSGYLS

SEQ ID NO: 1948 - DNA, 33 bp, Artificial Sequence
  Description of Artificial Sequence: Synthetic light chain variable region CDR L1
cggacaagtcagagcgttagcggctatttaagt

SEQ ID NO: 1949 - protein, 7 aa, Artificial Sequence
  Description of Artificial Sequence: Synthetic light chain variable region CDR L2
AASNLYS

SEQ ID NO: 1950 - DNA, 21 bp, Artificial Sequence
  Description of Artificial Sequence: Synthetic light chain variable region CDR L2
gcggcatccaatttgtacagt

SEQ ID NO: 1951 - protein, 9 aa, Artificial Sequence
  Description of Artificial Sequence: Synthetic light chain variable region CDR L3
QLNSGALFT

SEQ ID NO: 1952 - DNA, 27 bp, Artificial Sequence
  Description of Artificial Sequence: Synthetic light chain variable region CDR L3
caactgaattccggtgccctattcact

SEQ ID NO: 1953 - DNA, 363 bp, Artificial Sequence
  Description of Artificial Sequence: Synthetic heavy chain variable region
gaggtgcagctggtggagtctgggggaggcttggtcaagcctggagagtccgtgaaactctcctgcgcagcgtctggattcaccatcactgactcctacatggcctggatccgccagtctccagggaaggggctggagtggcttgcttacattagtagtactagtcttttcacagactacacagactctgtgaagggccgattcatcatcaccagagacaatgccgagaactcactctatctgcaaatgaccagcctgacaccggcagacacgggtgtctatttctgtgcgagggccaaaacatcctactacttctacgctctggacgtctggggcccaggcaccctggtcaccgtctcctca

SEQ ID NO: 1954 - protein, 121 aa, Artificial Sequence
  Description of Artificial Sequence: Synthetic heavy chain variable region
EVQLVESGGGLVKPGESVKLSCAASGFTITDSYMAWIRQSPGKGLEWLAYISSTSLFTDYTDSVKGRFIITRDNAENSLYLQMTSLTPADTGVYFCARAKTSYYFYALDVWGPGTLVTVSS

SEQ ID NO: 1955 - protein, 9 aa, Artificial Sequence
  Description of Artificial Sequence: Synthetic heavy chain variable region CDR H1
FTITDSYMA

SEQ ID NO: 1956 - DNA, 27 bp, Artificial Sequence
  Description of Artificial Sequence: Synthetic heavy chain variable region CDR H1
ttcaccatcactgactcctacatggcc

SEQ ID NO: 1957 - protein, 17 aa, Artificial Sequence
  Description of Artificial Sequence: Synthetic heavy chain variable region CDR H2
YISSTSLFTDYTDSVKG

SEQ ID NO: 1958 - DNA, 51 bp, Artificial Sequence
  Description of Artificial Sequence: Synthetic heavy chain variable region CDR H2
tacattagtagtactagtcttttcacagactacacagactctgtgaagggc

SEQ ID NO: 1959 - protein, 14 aa, Artificial Sequence
  Description of Artificial Sequence: Synthetic heavy chain variable region CDR H3
ARAKTSYYFYALDV

SEQ ID NO: 1960 - DNA, 42 bp, Artificial Sequence
  Description of Artificial Sequence: Synthetic heavy chain variable region CDR H3
gcgagggccaaaacatcctactacttctacgctctggacgtc

SEQ ID NO: 1961 - DNA, 321 bp, Artificial Sequence
  Description of Artificial Sequence: Synthetic light chain variable region
gaaacgacactcacgcagtctccaggcacgctgtctttgtctccgggggaaagagccaccctctcctgcagggccagtcagagtgttaacaacaactatctagcctggttccagcacaaacctggccaggctcccagactcctcatctataatgcatccaacagggccgctggcatcccagacaggttcagtggtagtgggtctgggacagacttcactctcaccatcagcaaactggagcctggagattctgcagtgtattactgtcagcgatatgggaactcttggccgttcggccaagggaccaaggtggaaatcaaa

SEQ ID NO: 1962 - protein, 107 aa, Artificial Sequence
  Description of Artificial Sequence: Synthetic light chain variable region
ETTLTQSPGTLSLSPGERATLSCRASQSVNNNYLAWFQHKPGQAPRLLIYNASNRAAGIPDRFSGSGSGTDFTLTISKLEPGDSAVYYCQRYGNSWPFGQGTKVEIK

SEQ ID NO: 1963 - protein, 12 aa, Artificial Sequence
  Description of Artificial Sequence: Synthetic light chain variable region CDR L1
RASQSVNNNYLA

SEQ ID NO: 1964 - DNA, 36 bp, Artificial Sequence
  Description of Artificial Sequence: Synthetic light chain variable region CDR L1
agggccagtcagagtgttaacaacaactatctagcc

SEQ ID NO: 1965 - protein, 7 aa, Artificial Sequence
  Description of Artificial Sequence: Synthetic light chain variable region CDR L2
NASNRAA

SEQ ID NO: 1966 - DNA, 21 bp, Artificial Sequence
  Description of Artificial Sequence: Synthetic light chain variable region CDR L2
aatgcatccaacagggccgct

SEQ ID NO: 1967 - protein, 8 aa, Artificial Sequence
  Description of Artificial Sequence: Synthetic light chain variable region CDR L3
QRYGNSWP

SEQ ID NO: 1968 - DNA, 24 bp, Artificial Sequence
  Description of Artificial Sequence: Synthetic light chain variable region CDR L3
cagcgatatgggaactcttggccg

SEQ ID NO: 1969 - DNA, 372 bp, Artificial Sequence
  Description of Artificial Sequence: Synthetic heavy chain variable region
caggtccagctggtgcagtctgggggaggcttggtacagcctggggggtccctgagactctcctgtgcagcctctggattcacctttagtcagtctcccatgagctgggtccgccaggctcctgggaaggggctggagtgggtctccggtattagtactggagggaccaatacatactacgcagactccgtgaagggccgcttcaccatctccagagacaattccaagaacacgttgtatctgcaaatgaccagcctgagagtcggggacacggccgtgtattactgtgcgaaagagagtttagactttggttcagggagctacaactggttcgacacctggggccagggaaccctggtcactgtctcctca

SEQ ID NO: 1970 - protein, 124 aa, Artificial Sequence
  Description of Artificial Sequence: Synthetic heavy chain variable region
QVQLVQSGGGLVQPGGSLRLSCAASGFTFSQSPMSWVRQAPGKGLEWVSGISTGGTNTYYADSVKGRFTISRDNSKNTLYLQMTSLRVGDTAVYYCAKESLDFGSGSYNWFDTWGQGTLVTVSS

SEQ ID NO: 1971 - protein, 9 aa, Artificial Sequence
  Description of Artificial Sequence: Synthetic heavy chain variable region CDR H1
FTFSQSPMS

SEQ ID NO: 1972 - DNA, 27 bp, Artificial Sequence
  Description of Artificial Sequence: Synthetic heavy chain variable region CDR H1
ttcacctttagtcagtctcccatgagc

SEQ ID NO: 1973 - protein, 17 aa, Artificial Sequence
  Description of Artificial Sequence: Synthetic heavy chain variable region CDR H2
GISTGGTNTYYADSVKG

SEQ ID NO: 1974 - DNA, 51 bp, Artificial Sequence
  Description of Artificial Sequence: Synthetic heavy chain variable region CDR H2
ggtattagtactggagggaccaatacatactacgcagactccgtgaagggc

SEQ ID NO: 1975 - protein, 17 aa, Artificial Sequence
  Description of Artificial Sequence: Synthetic heavy chain variable region CDR H3
AKESLDFGSGSYNWFDT

SEQ ID NO: 1976 - DNA, 51 bp, Artificial Sequence
  Description of Artificial Sequence: Synthetic heavy chain variable region CDR H3
gcgaaagagagtttagactttggttcagggagctacaactggttcgacacc

SEQ ID NO: 1977 - DNA, 336 bp, Artificial Sequence
  Description of Artificial Sequence: Synthetic light chain variable region
gaaattgtattgacgcagtctccagactccctggctgtgtctctgggcgagagggccaccatcaactgcaagtccagccagagtgttttatacaggtccaacaataagaactacttagcttggtaccagcagagaccaggacagcctcctaggctgctcatttcctgggcatctacccgggaatccggggtccctgaccgattcactggcagcgggtctgggacagatttcactctcaccatcagcagcctgcaggctgaagatgtggcagtttattactgtcaccaatattatgatacccacacttttggccaggggaccaaagtggatatcaaa

SEQ ID NO: 1978 - protein, 112 aa, Artificial Sequence
  Description of Artificial Sequence: Synthetic light chain variable region
EIVLTQSPDSLAVSLGERATINCKSSQSVLYRSNNKNYLAWYQQRPGQPPRLLISWASTRESGVPDRFTGSGSGTDFTLTISSLQAEDVAVYYCHQYYDTHTFGQGTKVDIK

SEQ ID NO: 1979 - protein, 17 aa, Artificial Sequence
  Description of Artificial Sequence: Synthetic light chain variable region CDR L1
KSSQSVLYRSNNKNYLA

SEQ ID NO: 1980 - DNA, 51 bp, Artificial Sequence
  Description of Artificial Sequence: Synthetic light chain variable region CDR L1
aagtccagccagagtgttttatacaggtccaacaataagaactacttagct

SEQ ID NO: 1981 - protein, 7 aa, Artificial Sequence
  Description of Artificial Sequence: Synthetic light chain variable region CDR L2
WASTRES

SEQ ID NO: 1982 - DNA, 21 bp, Artificial Sequence
  Description of Artificial Sequence: Synthetic light chain variable region CDR L2
tgggcatctacccgggaatcc

SEQ ID NO: 1983 - protein, 8 aa, Artificial Sequence
  Description of Artificial Sequence: Synthetic light chain variable region CDR L3
HQYYDTHT

SEQ ID NO: 1984 - DNA, 24 bp, Artificial Sequence
  Description of Artificial Sequence: Synthetic light chain variable region CDR L3
caccaatattatgatacccacact

SEQ ID NO: 1985 - DNA, 366 bp, Artificial Sequence
  Description of Artificial Sequence: Synthetic heavy chain variable region
gaggtgcagctggtggagtctgggggaggcgtggtccagcctgggaggtccctgagactctcctgtgtagcctctggattcagcttcagtgcctatggcatgcactgggttcgccaggttccaaccaaggggctggagtgggtggctgttatatcatatgatggaagagatatatactatacagactccgtgaagggccgattcaccatttccagagacaattccaagaacatgttgtatctgcaaatgaacagcctgagacctgaggacagggctgtctattactgtgcgagagatccgtccctcggttataataatcactactttgactattggggccagggaaccctggtcaccgtctcttca

SEQ ID NO: 1986 - protein, 122 aa, Artificial Sequence
  Description of Artificial Sequence: Synthetic heavy chain variable region
EVQLVESGGGVVQPGRSLRLSCVASGFSFSAYGMHWVRQVPTKGLEWVAVISYDGRDIYYTDSVKGRFTISRDNSKNMLYLQMNSLRPEDRAVYYCARDPSLGYNNHYFDYWGQGTLVTVSS

SEQ ID NO: 1987 - protein, 9 aa, Artificial Sequence
  Description of Artificial Sequence: Synthetic heavy chain variable region CDR H1
FSFSAYGMH

SEQ ID NO: 1988 - DNA, 27 bp, Artificial Sequence
  Description of Artificial Sequence: Synthetic heavy chain variable region CDR H1
ttcagcttcagtgcctatggcatgcac

SEQ ID NO: 1989 - protein, 17 aa, Artificial Sequence
  Description of Artificial Sequence: Synthetic heavy chain variable region CDR H2
VISYDGRDIYYTDSVKG

SEQ ID NO: 1990 - DNA, 51 bp, Artificial Sequence
  Description of Artificial Sequence: Synthetic heavy chain variable region CDR H2
gttatatcatatgatggaagagatatatactatacagactccgtgaagggc

SEQ ID NO: 1991 - protein, 15 aa, Artificial Sequence
  Description of Artificial Sequence: Synthetic heavy chain variable region CDR H3
ARDPSLGYNNHYFDY

SEQ ID NO: 1992 - DNA, 45 bp, Artificial Sequence
  Description of Artificial Sequence: Synthetic heavy chain variable region CDR H3
gcgagagatccgtccctcggttataataatcactactttgactat

SEQ ID NO: 1993 - DNA, 327 bp, Artificial Sequence
  Description of Artificial Sequence: Synthetic light chain variable region
gaaattgtgttgacgcagtctccagccaccctgtctttgtctccaggggaaacagccaccctctcctgcagggccagtcagagtgttaccggcaacttagcctggtaccaacagaaacctggccaggctcccaggctcctcatctatgctgcatccaacagggccactggcatcccagccaggttcagtggcagtgggtctgggacagacttcactctcaccatcagcagcctagagcctgaagattttgcagtttatttctgtcagcagcgtagcaactggcctcctatgtacagttttggccaggggaccaagctggagatcaaa

SEQ ID NO: 1994 - protein, 109 aa, Artificial Sequence
  Description of Artificial Sequence: Synthetic light chain variable region
EIVLTQSPATLSLSPGETATLSCRASQSVTGNLAWYQQKPGQAPRLLIYAASNRATGIPARFSGSGSGTDFTLTISSLEPEDFAVYFCQQRSNWPPMYSFGQGTKLEIK

SEQ ID NO: 1995 - protein, 11 aa, Artificial Sequence
  Description of Artificial Sequence: Synthetic light chain variable region CDR L1
RASQSVTGNLA

SEQ ID NO: 1996 - DNA, 33 bp, Artificial Sequence
  Description of Artificial Sequence: Synthetic light chain variable region CDR L1
agggccagtcagagtgttaccggcaacttagcc

SEQ ID NO: 1997 - protein, 7 aa, Artificial Sequence
  Description of Artificial Sequence: Synthetic light chain variable region CDR L2
AASNRAT

SEQ ID NO: 1998 - DNA, 21 bp, Artificial Sequence
  Description of Artificial Sequence: Synthetic light chain variable region CDR L2
gctgcatccaacagggccact

SEQ ID NO: 1999 - protein, 11 aa, Artificial Sequence
  Description of Artificial Sequence: Synthetic light chain variable region CDR L3
QQRSNWPPMYS

SEQ ID NO: 2000 - DNA, 33 bp, Artificial Sequence
  Description of Artificial Sequence: Synthetic light chain variable region CDR L3
cagcagcgtagcaactggcctcctatgtacagt

SEQ ID NO: 2001 - DNA, 375 bp, Artificial Sequence
  Description of Artificial Sequence: Synthetic heavy chain variable region
caggtccagcttgtacagtctggggctgaggtgaagaggcctgggtcctcggtgaaggtctcctgcaaggcctctggaggcaccttcagaggctaccatatcagctgggtgcgacaggcccctggacaagggctcgagtggatgggagggatcatccatctatttgggacagtaagctacgctccgaagttccagggcagagtcacgatcaccgcggacgcatccacgggcacagcccatatggagttgagcagcctgacatctgacgacacggccatatactattgtgcgagagatgcttacgaagtctggacgggttcttatctccccccttttgactactggggccagggaaccctggtcaccgtctcctca

SEQ ID NO: 2002 - protein, 125 aa, Artificial Sequence
  Description of Artificial Sequence: Synthetic heavy chain variable region
QVQLVQSGAEVKRPGSSVKVSCKASGGTFRGYHISWVRQAPGQGLEWMGGIIHLFGTVSYAPKFQGRVTITADASTGTAHMELSSLTSDDTAIYYCARDAYEVWTGSYLPPFDYWGQGTLVTVSS

SEQ ID NO: 2003 - protein, 9 aa, Artificial Sequence
  Description of Artificial Sequence: Synthetic heavy chain variable region CDR H1
GTFRGYHIS

SEQ ID NO: 2004 - DNA, 27 bp, Artificial Sequence
  Description of Artificial Sequence: Synthetic heavy chain variable region CDR H1
ggcaccttcagaggctaccatatcagc

SEQ ID NO: 2005 - protein, 17 aa, Artificial Sequence
  Description of Artificial Sequence: Synthetic heavy chain variable region CDR H2
GIIHLFGTVSYAPKFQG

SEQ ID NO: 2006 - DNA, 51 bp, Artificial Sequence
  Description of Artificial Sequence: Synthetic heavy chain variable region CDR H2
gggatcatccatctatttgggacagtaagctacgctccgaagttccagggc

SEQ ID NO: 2007 - protein, 18 aa, Artificial Sequence
  Description of Artificial Sequence: Synthetic heavy chain variable region CDR H3
ARDAYEVWTGSYLPPFDY

SEQ ID NO: 2008 - DNA, 54 bp, Artificial Sequence
  Description of Artificial Sequence: Synthetic heavy chain variable region CDR H3
gcgagagatgcttacgaagtctggacgggttcttatctccccccttttgactac

SEQ ID NO: 2009 - DNA, 324 bp, Artificial Sequence
  Description of Artificial Sequence: Synthetic light chain variable region
gatattgtgatgactcagactccaggcaccctgtctttgtctcccggggaaagagtcaccctctcctgcagggccagtcagactgttacaagcagctacttagcctggtaccagcagaaacctggccaggctcccagactcctcatctatggtgcattcaccagggccactggcatcccagacaggttcagtggtagtgggtctgggacagacttcactctcaccatcagcagactggagcctgaagattttgcagtatattactgtcagcagtatggtagctcattcctcactttcggcggagggaccaagctggagatcaaa

SEQ ID NO: 2010 - protein, 108 aa, Artificial Sequence
  Description of Artificial Sequence: Synthetic light chain variable region
DIVMTQTPGTLSLSPGERVTLSCRASQTVTSSYLAWYQQKPGQAPRLLIYGAFTRATGIPDRFSGSGSGTDFTLTISRLEPEDFAVYYCQQYGSSFLTFGGGTKLEIK

SEQ ID NO: 2011 - protein, 12 aa, Artificial Sequence
  Description of Artificial Sequence: Synthetic light chain variable region CDR L1
RASQTVTSSYLA

SEQ ID NO: 2012 - DNA, 36 bp, Artificial Sequence; identical to SEQ ID NO: 844
  Description of Artificial Sequence: Synthetic light chain variable region CDR L1

SEQ ID NO: 2013 - protein, 7 aa, Artificial Sequence
  Description of Artificial Sequence: Synthetic light chain variable region CDR L2
GAFTRAT

SEQ ID NO: 2014 - DNA, 21 bp, Artificial Sequence
  Description of Artificial Sequence: Synthetic light chain variable region CDR L2
ggtgcattcaccagggccact

SEQ ID NO: 2015 - protein, 9 aa, Artificial Sequence
  Description of Artificial Sequence: Synthetic light chain variable region CDR L3
QQYGSSFLT

SEQ ID NO: 2016 - DNA, 27 bp, Artificial Sequence
  Description of Artificial Sequence: Synthetic light chain variable region CDR L3
cagcagtatggtagctcattcctcact

SEQ ID NO: 2017 - DNA, 372 bp, Artificial Sequence
  Description of Artificial Sequence: Synthetic heavy chain variable region
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatgtgcaatatagtggctacgattctgggtactactttgactactggggccagggaaccctggtcactgtctcctca

SEQ ID NO: 2018 - protein, 124 aa, Artificial Sequence
  Description of Artificial Sequence: Synthetic heavy chain variable region
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDVQYSGYDSGYYFDYWGQGTLVTVSS

SEQ ID NO: 2019 - protein, 9 aa, Artificial Sequence
  Description of Artificial Sequence: Synthetic heavy chain variable region CDR H1
FTFSSYSMN

SEQ ID NO: 2020 - DNA, 27 bp, Artificial Sequence
  Description of Artificial Sequence: Synthetic heavy chain variable region CDR H1
ttcaccttcagtagctatagcatgaac

SEQ ID NO: 2021 - protein, 17 aa, Artificial Sequence
  Description of Artificial Sequence: Synthetic heavy chain variable region CDR H2
SISSSSSYIYYADSVKG

SEQ ID NO: 2022 - DNA, 51 bp, Artificial Sequence; identical to SEQ ID NO: 726
  Description of Artificial Sequence: Synthetic heavy chain variable region CDR H2

SEQ ID NO: 2023 - protein, 17 aa, Artificial Sequence
  Description of Artificial Sequence: Synthetic heavy chain variable region CDR H3
ARDVQYSGYDSGYYFDY

SEQ ID NO: 2024 - DNA, 51 bp, Artificial Sequence
  Description of Artificial Sequence: Synthetic heavy chain variable region CDR H3
gcgagagatgtgcaatatagtggctacgattctgggtactactttgactac

SEQ ID NO: 2025 - DNA, 336 bp, Artificial Sequence
  Description of Artificial Sequence: Synthetic light chain variable region
cagcctgtgctgactcagccaccctcagtgtctggggccccaggacagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgccctttatgtcttcggaactgggaccaaggtgaccgtccta

SEQ ID NO: 2026 - protein, 112 aa, Artificial Sequence
  Description of Artificial Sequence: Synthetic light chain variable region
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL

SEQ ID NO: 2027 - protein, 14 aa, Artificial Sequence
  Description of Artificial Sequence: Synthetic light chain variable region CDR L1
TGSSSNIGAGYDVH

SEQ ID NO: 2028 - DNA, 42 bp, Artificial Sequence; identical to SEQ ID NO: 572
  Description of Artificial Sequence: Synthetic light chain variable region CDR L1

SEQ ID NO: 2029 - protein, 7 aa, Artificial Sequence
  Description of Artificial Sequence: Synthetic light chain variable region CDR L2
GNSNRPS

SEQ ID NO: 2030 - DNA, 21 bp, Artificial Sequence
  Description of Artificial Sequence: Synthetic light chain variable region CDR L2
ggtaacagcaatcggccctca

SEQ ID NO: 2031 - protein, 12 aa, Artificial Sequence
  Description of Artificial Sequence: Synthetic light chain variable region CDR L3
QSYDSSLSALYV

SEQ ID NO: 2032 - DNA, 36 bp, Artificial Sequence
  Description of Artificial Sequence: Synthetic light chain variable region CDR L3
cagtcctatgacagcagcctgagtgccctttatgtc

SEQ ID NO: 2033 - DNA, 360 bp, Artificial Sequence
  Description of Artificial Sequence: Synthetic heavy chain variable region
gaggtgcagctggtggagtctgggggaggcgtggtccagccgggggggtccctgagactctcctgtgcaggctctggattcgccttcggtagcttcgcgatgcactgggtccgtcaggctccaggcaaggggctggagtgggtggctgttatttcatttgacggaaagaatacaaaatatgctgactccgtgaagggccgattcaccacctccagagacaattccaggaacacgctctatctccaaatggacagcctgagaggtgacgacacggctatatattactgcgcgacaattaggggaattgtggctggcctttgtgacaactggggccagggaaccctggtcaccgtctcctca

SEQ ID NO: 2034 - protein, 120 aa, Artificial Sequence
  Description of Artificial Sequence: Synthetic heavy chain variable region
EVQLVESGGGVVQPGGSLRLSCAGSGFAFGSFAMHWVRQAPGKGLEWVAVISFDGKNTKYADSVKGRFTTSRDNSRNTLYLQMDSLRGDDTAIYYCATIRGIVAGLCDNWGQGTLVTVSS

SEQ ID NO: 2035 - protein, 9 aa, Artificial Sequence
  Description of Artificial Sequence: Synthetic heavy chain variable region CDR H1
FAFGSFAMH

SEQ ID NO: 2036 - DNA, 27 bp, Artificial Sequence
  Description of Artificial Sequence: Synthetic heavy chain variable region CDR H1
ttcgccttcggtagcttcgcgatgcac

SEQ ID NO: 2037 - protein, 17 aa, Artificial Sequence
  Description of Artificial Sequence: Synthetic heavy chain variable region CDR H2
VISFDGKNTKYADSVKG

SEQ ID NO: 2038 - DNA, 51 bp, Artificial Sequence
  Description of Artificial Sequence: Synthetic heavy chain variable region CDR H2
gttatttcatttgacggaaagaatacaaaatatgctgactccgtgaagggc

SEQ ID NO: 2039 - protein, 13 aa, Artificial Sequence
  Description of Artificial Sequence: Synthetic heavy chain variable region CDR H3
ATIRGIVAGLCDN

SEQ ID NO: 2040 - DNA, 39 bp, Artificial Sequence
  Description of Artificial Sequence: Synthetic heavy chain variable region CDR H3
gcgacaattaggggaattgtggctggcctttgtgacaac

SEQ ID NO: 2041 - DNA, 336 bp, Artificial Sequence
  Description of Artificial Sequence: Synthetic light chain variable region
cagcctgtgctgactcaatcatcgtctgactctgcttccctgggagcctcggtcaagctcacctgtactctgagcagtggccacagaaactacatcatcgcatggcatcaacaacaaccagggaaggcccctcggttcctgatgaaggttgaaggtagtggaagcttcaccatggggagcggagttcctgatcgcttctcgggctccagctctggggctgaccgctacctcaccatctccaacctccagtctgaggatgaggctgattattactgtgaggcctgggactttaacacggggggggtcttcggcggaggcacccagctgaccgtcctc

SEQ ID NO: 2042 - protein, 112 aa, Artificial Sequence
  Description of Artificial Sequence: Synthetic light chain variable region
QPVLTQSSSDSASLGASVKLTCTLSSGHRNYIIAWHQQQPGKAPRFLMKVEGSGSFTMGSGVPDRFSGSSSGADRYLTISNLQSEDEADYYCEAWDFNTGGVFGGGTQLTVL

SEQ ID NO: 2043 - protein, 12 aa, Artificial Sequence
  Description of Artificial Sequence: Synthetic light chain variable region CDR L1
TLSSGHRNYIIA

SEQ ID NO: 2044 - DNA, 36 bp, Artificial Sequence
  Description of Artificial Sequence: Synthetic light chain variable region CDR L1
actctgagcagtggccacagaaactacatcatcgca

SEQ ID NO: 2045 - protein, 11 aa, Artificial Sequence
  Description of Artificial Sequence: Synthetic light chain variable region CDR L2
VEGSGSFTMGS

SEQ ID NO: 2046 - DNA, 33 bp, Artificial Sequence
  Description of Artificial Sequence: Synthetic light chain variable region CDR L2
gttgaaggtagtggaagcttcaccatggggagc

SEQ ID NO: 2047 - protein, 10 aa, Artificial Sequence
  Description of Artificial Sequence: Synthetic light chain variable region CDR L3
EAWDFNTGGV

SEQ ID NO: 2048 - DNA, 30 bp, Artificial Sequence
  Description of Artificial Sequence: Synthetic light chain variable region CDR L3
gaggcctgggactttaacacggggggggtc

SEQ ID NO: 2049 - DNA, 375 bp, Artificial Sequence
  Description of Artificial Sequence: Synthetic heavy chain variable region
gaggtgcagctggtggagtcgggcccaggactggtgaagccttcggggaccctgtccctcacctgcgctgtctctggtgactccatcgtcggtagtgactggtggagttggatccgccagccccccgggaaggggctggagtggattggagatatctatcatggtgggaccaccagctacaacccgtcccttaagagtcgagtcaccatgtcagtagacaagtccaagaaccaattctccctgaagctgacctctgtcaccgccgcggacacagccgtgtattactgtgcgagactctcgggaaattgtagtggtggtagctgttactcgccctttgaccactggggccagggaaccctggtcaccgtctcttca

SEQ ID NO: 2050 - protein, 125 aa, Artificial Sequence
  Description of Artificial Sequence: Synthetic heavy chain variable region
EVQLVESGPGLVKPSGTLSLTCAVSGDSIVGSDWWSWIRQPPGKGLEWIGDIYHGGTTSYNPSLKSRVTMSVDKSKNQFSLKLTSVTAADTAVYYCARLSGNCSGGSCYSPFDHWGQGTLVTVSS

SEQ ID NO: 2051 - protein, 10 aa, Artificial Sequence
  Description of Artificial Sequence: Synthetic heavy chain variable region CDR H1
DSIVGSDWWS

SEQ ID NO: 2052 - DNA, 30 bp, Artificial Sequence
  Description of Artificial Sequence: Synthetic heavy chain variable region CDR H1
gactccatcgtcggtagtgactggtggagt

SEQ ID NO: 2053 - protein, 16 aa, Artificial Sequence
  Description of Artificial Sequence: Synthetic heavy chain variable region CDR H2
DIYHGGTTSYNPSLKS

SEQ ID NO: 2054 - DNA, 48 bp, Artificial Sequence
  Description of Artificial Sequence: Synthetic heavy chain variable region CDR H2
gatatctatcatggtgggaccaccagctacaacccgtcccttaagagt

SEQ ID NO: 2055 - protein, 18 aa, Artificial Sequence
  Description of Artificial Sequence: Synthetic heavy chain variable region CDR H3
ARLSGNCSGGSCYSPFDH

SEQ ID NO: 2056 - DNA, 54 bp, Artificial Sequence
  Description of Artificial Sequence: Synthetic heavy chain variable region CDR H3
gcgagactctcgggaaattgtagtggtggtagctgttactcgccctttgaccac

SEQ ID NO: 2057 - DNA, 321 bp, Artificial Sequence
  Description of Artificial Sequence: Synthetic light chain variable region
gacatccagatgacccagtctccatcctccttgtctgcatctgtgggagacagagtcaccatcacttgccgggcaagtcagaccattaatggttatttaaattggtatcaacaaagaccagggaaagcccctaaactcctgatctctgctgcatccagtttgcagagtggggtcccatcaaggttccgtggcagtggatatgggacagatttcactctcaccatcagcagtctgcaacctgaagattttgcaacttatttctgtcaacagagttacaatactgtgtacacttttgggcaggggaccaaagtggatatcaaa

SEQ ID NO: 2058 - protein, 107 aa, Artificial Sequence
  Description of Artificial Sequence: Synthetic light chain variable region
DIQMTQSPSSLSASVGDRVTITCRASQTINGYLNWYQQRPGKAPKLLISAASSLQSGVPSRFRGSGYGTDFTLTISSLQPEDFATYFCQQSYNTVYTFGQGTKVDIK

SEQ ID NO: 2059 - protein, 11 aa, Artificial Sequence
  Description of Artificial Sequence: Synthetic light chain variable region CDR L1
RASQTINGYLN

SEQ ID NO: 2060 - DNA, 33 bp, Artificial Sequence
  Description of Artificial Sequence: Synthetic light chain variable region CDR L1
cgggcaagtcagaccattaatggttatttaaat

SEQ ID NO: 2061 - protein, 7 aa, Artificial Sequence
  Description of Artificial Sequence: Synthetic light chain variable region CDR L2
AASSLQS

SEQ ID NO: 2062 - DNA, 21 bp, Artificial Sequence
  Description of Artificial Sequence: Synthetic light chain variable region CDR L2
gctgcatccagtttgcagagt

SEQ ID NO: 2063 - protein, 9 aa, Artificial Sequence
  Description of Artificial Sequence: Synthetic light chain variable region CDR L3
QQSYNTVYT

SEQ ID NO: 2064 - DNA, 27 bp, Artificial Sequence
  Description of Artificial Sequence: Synthetic light chain variable region CDR L3
caacagagttacaatactgtgtacact

SEQ ID NO: 2065 - DNA, 357 bp, Artificial Sequence
  Description of Artificial Sequence: Synthetic heavy chain variable region
caggtgcagctggtgcagtctggagcagaggtgaaaaagcccggggagtctctgaagatctcctgtaagggttctggatacagctttagcagctactggatcggctgggtgcgccagatgcccgggaaaggcctggagtggatggggatcatctatcctggtgactctgataccagatacagcccgtcgctccaaggccaggtcaccatctcaggcgacaagtccatcagtaccgccttcctgcagtggagcagcctgaaggcctcggacaccgccatgtattactgtgcgagacccatgactacccaagaaggttttgatttgtggggccaagggacaatggtcaccgtctcttca

SEQ ID NO: 2066 - protein, 119 aa, Artificial Sequence
  Description of Artificial Sequence: Synthetic heavy chain variable region
QVQLVQSGAEVKKPGESLKISCKGSGYSFSSYWIGWVRQMPGKGLEWMGIIYPGDSDTRYSPSLQGQVTISGDKSISTAFLQWSSLKASDTAMYYCARPMTTQEGFDLWGQGTMVTVSS

SEQ ID NO: 2067 - protein, 9 aa, Artificial Sequence
  Description of Artificial Sequence: Synthetic heavy chain variable region CDR H1
YSFSSYWIG

SEQ ID NO: 2068 - DNA, 27 bp, Artificial Sequence
  Description of Artificial Sequence: Synthetic heavy chain variable region CDR H1
tacagctttagcagctactggatcggc

SEQ ID NO: 2069 - protein, 17 aa, Artificial Sequence
  Description of Artificial Sequence: Synthetic heavy chain variable region CDR H2
IIYPGDSDTRYSPSLQG

SEQ ID NO: 2070 - DNA, 51 bp, Artificial Sequence
  Description of Artificial Sequence: Synthetic heavy chain variable region CDR H2
atcatctatcctggtgactctgataccagatacagcccgtcgctccaaggc

SEQ ID NO: 2071 - protein, 12 aa, Artificial Sequence
  Description of Artificial Sequence: Synthetic heavy chain variable region CDR H3
ARPMTTQEGFDL

SEQ ID NO: 2072 - DNA, 36 bp, Artificial Sequence
  Description of Artificial Sequence: Synthetic heavy chain variable region CDR H3
gcgagacccatgactacccaagaaggttttgatttg

SEQ ID NO: 2073 - DNA, 324 bp, Artificial Sequence
  Description of Artificial Sequence: Synthetic light chain variable region
gacatccggttgacccagtctccatcttctgtgtctgcatctgtaggagacagagtcaccatcacttgtcgggcgagtcagggtattagcgactggttagcctggtatcagcagaaaccagggaaagcccctaaactcctgatctatgctgcatccagtttgcaaagtggggtcccatcaaggttcagcggcagtggatctgggacagatttcactctcactatcagcagcctgcagcctgaagattttgcaacttactattgtcaacagactaacagtttcctcccgctcactttcggcggagggaccaaagtggatatcaaa

SEQ ID NO: 2074 - protein, 108 aa, Artificial Sequence
  Description of Artificial Sequence: Synthetic light chain variable region
DIRLTQSPSSVSASVGDRVTITCRASQGISDWLAWYQQKPGKAPKLLIYAASSLQSGVPSRFSGSGSGTDFTLTISSLQPEDFATYYCQQTNSFLPLTFGGGTKVDIK

SEQ ID NO: 2075 - protein, 11 aa, Artificial Sequence
  Description of Artificial Sequence: Synthetic light chain variable region CDR L1
RASQGISDWLA

SEQ ID NO: 2076 - DNA, 33 bp, Artificial Sequence
  Description of Artificial Sequence: Synthetic light chain variable region CDR L1
cgggcgagtcagggtattagcgactggttagcc

SEQ ID NO: 2077 - protein, 7 aa, Artificial Sequence
  Description of Artificial Sequence: Synthetic light chain variable region CDR L2
AASSLQS

SEQ ID NO: 2078 - DNA, 21 bp, Artificial Sequence
  Description of Artificial Sequence: Synthetic light chain variable region CDR L2
gctgcatccagtttgcaaagt

SEQ ID NO: 2079 - protein, 10 aa, Artificial Sequence
  Description of Artificial Sequence: Synthetic light chain variable region CDR L3
QQTNSFLPLT

SEQ ID NO: 2080 - DNA, 30 bp, Artificial Sequence
  Description of Artificial Sequence: Synthetic light chain variable region CDR L3
caacagactaacagtttcctcccgctcact

SEQ ID NO: 2081 - DNA, 378 bp, Artificial Sequence
  Description of Artificial Sequence: Synthetic heavy chain variable region
gaggtgcagctggtggagtcgggcccccgactggtgaagccttcacagaccctgtccctcacctgcaccgtctatggtggctccatcagcggtggtcaaaactactacagttgggtccgccagcccccagggaagggcctggagtggattgggtacatcttttccagtgggaccacctactacaagccgtccctcaagagtcgaatttccatttcatttgacacgtccaagaaccagttctccctgaacctggcctctgtgacggccgcagacacggccgtatatttctgtgccagatccgctgacattgatatcgtttgggggagttctctctacatgcctctctggggccagggaaccctggtcaccgtctcctca

SEQ ID NO: 2082 - protein, 126 aa, Artificial Sequence
  Description of Artificial Sequence: Synthetic heavy chain variable region
EVQLVESGPRLVKPSQTLSLTCTVYGGSISGGQNYYSWVRQPPGKGLEWIGYIFSSGTTYYKPSLKSRISISFDTSKNQFSLNLASVTAADTAVYFCARSADIDIVWGSSLYMPLWGQGTLVTVSS

SEQ ID NO: 2083 - protein, 11 aa, Artificial Sequence
  Description of Artificial Sequence: Synthetic heavy chain variable region CDR H1
GSISGGQNYYS

SEQ ID NO: 2084 - DNA, 33 bp, Artificial Sequence
  Description of Artificial Sequence: Synthetic heavy chain variable region CDR H1
ggctccatcagcggtggtcaaaactactacagt

SEQ ID NO: 2085 - protein, 16 aa, Artificial Sequence
  Description of Artificial Sequence: Synthetic heavy chain variable region CDR H2
YIFSSGTTYYKPSLKS

SEQ ID NO: 2086 - DNA, 48 bp, Artificial Sequence
  Description of Artificial Sequence: Synthetic heavy chain variable region CDR H2
tacatcttttccagtgggaccacctactacaagccgtccctcaagagt

SEQ ID NO: 2087 - protein, 18 aa, Artificial Sequence
  Description of Artificial Sequence: Synthetic heavy chain variable region CDR H3
ARSADIDIVWGSSLYMPL

SEQ ID NO: 2088 - DNA, 54 bp, Artificial Sequence
  Description of Artificial Sequence: Synthetic heavy chain variable region CDR H3
gccagatccgctgacattgatatcgtttgggggagttctctctacatgcctctc

SEQ ID NO: 2089 - DNA, 324 bp, Artificial Sequence
  Description of Artificial Sequence: Synthetic light chain variable region
gaaattgtgttgacgcagtctccaggcaccctgtctttgtctccaggacaaagagccaccctctcctgcagggccactcacattgtcagtaacagctacttagcctggtaccagcagaaacctggccaggctcccaggctcctcatccatggtgtttccatcagggccactggcatcccagacaggttctctggcagtgggtctgggacagacttcactctcaccatcagcagactggagcctgaagattttgcagtgtatttctgtcagcagtatggtacctcaccgtggacgttcggccaagggaccaagctggagatcaaa

SEQ ID NO: 2090 - protein, 108 aa, Artificial Sequence
  Description of Artificial Sequence: Synthetic light chain variable region
EIVLTQSPGTLSLSPGQRATLSCRATHIVSNSYLAWYQQKPGQAPRLLIHGVSIRATGIPDRFSGSGSGTDFTLTISRLEPEDFAVYFCQQYGTSPWTFGQGTKLEIK

SEQ ID NO: 2091 - protein, 12 aa, Artificial Sequence
  Description of Artificial Sequence: Synthetic light chain variable region CDR L1
RATHIVSNSYLA

SEQ ID NO: 2092 - DNA, 36 bp, Artificial Sequence
  Description of Artificial Sequence: Synthetic light chain variable region CDR L1
agggccactcacattgtcagtaacagctacttagcc

SEQ ID NO: 2093 - protein, 7 aa, Artificial Sequence
  Description of Artificial Sequence: Synthetic light chain variable region CDR L2
GVSIRAT

SEQ ID NO: 2094 - DNA, 21 bp, Artificial Sequence
  Description of Artificial Sequence: Synthetic light chain variable region CDR L2
ggtgtttccatcagggccact

SEQ ID NO: 2095 - protein, 9 aa, Artificial Sequence
  Description of Artificial Sequence: Synthetic light chain variable region CDR L3
QQYGTSPWT

SEQ ID NO: 2096 - DNA, 27 bp, Artificial Sequence
  Description of Artificial Sequence: Synthetic light chain variable region CDR L3
cagcagtatggtacctcaccgtggacg

SEQ ID NO: 2097 - DNA, 372 bp, Artificial Sequence
  Description of Artificial Sequence: Synthetic heavy chain variable region
caggtgcagctggtggagtctgggggaggcctggtcaagccgggggggtccctgagactctcctgtgtagcctctggatttaccttcagcagttatgccatgaattgggtccgccaggctccagggaaggggctggactgggtctcctctatcagtgctggtagcaatttcatagacgacgcagactcagtgaagggccgcttcaccatctccagagacaacgccaggaactcactgtttctgcagatgaacagcctgagagccgaggacacggctgtgtattactgtgcgagaattgggtacagtagcgcgcaccactaccagtactacatggacgtctggggcacggggaccacggtcaccgtctcctca

SEQ ID NO: 2098 - protein, 124 aa, Artificial Sequence
  Description of Artificial Sequence: Synthetic heavy chain variable region
QVQLVESGGGLVKPGGSLRLSCVASGFTFSSYAMNWVRQAPGKGLDWVSSISAGSNFIDDADSVKGRFTISRDNARNSLFLQMNSLRAEDTAVYYCARIGYSSAHHYQYYMDVWGTGTTVTVSS

SEQ ID NO: 2099 - protein, 9 aa, Artificial Sequence
  Description of Artificial Sequence: Synthetic heavy chain variable region CDR H1
FTFSSYAMN

SEQ ID NO: 2100 - DNA, 27 bp, Artificial Sequence
  Description of Artificial Sequence: Synthetic heavy chain variable region CDR H1
tttaccttcagcagttatgccatgaat

SEQ ID NO: 2101 - protein, 17 aa, Artificial Sequence
  Description of Artificial Sequence: Synthetic heavy chain variable region CDR H2
SISAGSNFIDDADSVKG

SEQ ID NO: 2102 - DNA, 51 bp, Artificial Sequence
  Description of Artificial Sequence: Synthetic heavy chain variable region CDR H2
tctatcagtgctggtagcaatttcatagacgacgcagactcagtgaagggc

SEQ ID NO: 2103 - protein, 17 aa, Artificial Sequence
  Description of Artificial Sequence: Synthetic heavy chain variable region CDR H3
ARIGYSSAHHYQYYMDV

SEQ ID NO: 2104 - DNA, 51 bp, Artificial Sequence
  Description of Artificial Sequence: Synthetic heavy chain variable region CDR H3
gcgagaattgggtacagtagcgcgcaccactaccagtactacatggacgtc

SEQ ID NO: 2105 - DNA, 336 bp, Artificial Sequence
  Description of Artificial Sequence: Synthetic light chain variable region
cagtctgtcctgacgcagccgccctcagtgtctggggccccagggcagagggtcaccatctcctgcactggcagcagctccaacatcggggcaggttatgatgtccactggtaccaggatcttccaggaactgcccccaaactcctcatctatggtaacaccaatcggccctcaggggtccctgaccgattctctggctccaagtctggcgcctcagcctccctggtcatcactgggctccaggctgaggatgaggctgattattactgccagtcctatgacaagagcctgagtggtgggtatgtcttcggaactgggaccaaggtcaccgtccta

SEQ ID NO: 2106 - protein, 112 aa, Artificial Sequence
  Description of Artificial Sequence: Synthetic light chain variable region
QSVLTQPPSVSGAPGQRVTISCTGSSSNIGAGYDVHWYQDLPGTAPKLLIYGNTNRPSGVPDRFSGSKSGASASLVITGLQAEDEADYYCQSYDKSLSGGYVFGTGTKVTVL

SEQ ID NO: 2107 - protein, 14 aa, Artificial Sequence
  Description of Artificial Sequence: Synthetic light chain variable region CDR L1
TGSSSNIGAGYDVH

SEQ ID NO: 2108 - DNA, 42 bp, Artificial Sequence
  Description of Artificial Sequence: Synthetic light chain variable region CDR L1
actggcagcagctccaacatcggggcaggttatgatgtccac

SEQ ID NO: 2109 - protein, 7 aa, Artificial Sequence
  Description of Artificial Sequence: Synthetic light chain variable region CDR L2
GNTNRPS

SEQ ID NO: 2110 - DNA, 21 bp, Artificial Sequence
  Description of Artificial Sequence: Synthetic light chain variable region CDR L2
ggtaacaccaatcggccctca

SEQ ID NO: 2111 - protein, 12 aa, Artificial Sequence
  Description of Artificial Sequence: Synthetic light chain variable region CDR L3
QSYDKSLSGGYV

SEQ ID NO: 2112 - DNA, 36 bp, Artificial Sequence
  Description of Artificial Sequence: Synthetic light chain variable region CDR L3
cagtcctatgacaagagcctgagtggtgggtatgtc

SEQ ID NO: 2113 - DNA, 363 bp, Artificial Sequence
  Description of Artificial Sequence: Synthetic heavy chain variable region
caggtccagctggtgcagtctggggctgaggtgaagaagcctggggcctcagtgagggtcacctgcaaggcctctggatacaccttcaccgactactttatgaactgggtgcgacaggcccctggagggggccttgagtggatggggtggatcaatcctctcagtggagtcacaaaatatgcacagcagtttcagggcagtgtcaccatgaccactgacacgtccatcaccacaggctacatggagctgaggagcctgagagttgacgacacggccgtctattattgtgcgagccagtcttccccttacaccccgggcgccatgggcgtctggggccaagggaccacggtcaccgtctcttca

SEQ ID NO: 2114 - protein, 121 aa, Artificial Sequence
  Description of Artificial Sequence: Synthetic heavy chain variable region
QVQLVQSGAEVKKPGASVRVTCKASGYTFTDYFMNWVRQAPGGGLEWMGWINPLSGVTKYAQQFQGSVTMTTDTSITTGYMELRSLRVDDTAVYYCASQSSPYTPGAMGVWGQGTTVTVSS

SEQ ID NO: 2115 - protein, 9 aa, Artificial Sequence
  Description of Artificial Sequence: Synthetic heavy chain variable region CDR H1
YTFTDYFMN

SEQ ID NO: 2116 - DNA, 27 bp, Artificial Sequence
  Description of Artificial Sequence: Synthetic heavy chain variable region CDR H1
tacaccttcaccgactactttatgaac

SEQ ID NO: 2117 - protein, 17 aa, Artificial Sequence
  Description of Artificial Sequence: Synthetic heavy chain variable region CDR H2
WINPLSGVTKYAQQFQG

SEQ ID NO: 2118 - DNA, 51 bp, Artificial Sequence; identical to SEQ ID NO: 1942
  Description of Artificial Sequence: Synthetic heavy chain variable region CDR H2

SEQ ID NO: 2119 - protein, 14 aa, Artificial Sequence
  Description of Artificial Sequence: Synthetic heavy chain variable region CDR H3
ASQSSPYTPGAMGV

SEQ ID NO: 2120 - DNA, 42 bp, Artificial Sequence; identical to SEQ ID NO: 1944
  Description of Artificial Sequence: Synthetic heavy chain variable region CDR H3

SEQ ID NO: 2121 - DNA, 327 bp, Artificial Sequence
  Description of Artificial Sequence: Synthetic light chain variable region
tcctatgagctgatacagctaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatccggtggtgttcggcggagggaccaagctcaccgtccta

SEQ ID NO: 2122 - protein, 109 aa, Artificial Sequence
  Description of Artificial Sequence: Synthetic light chain variable region
SYELIQLPSVSVSPGQTARITCSGDALPKQYAYWYQQKPGQAPVLVIYKDSERPSGIPERFSGSSSGTTVTLTISGVQAEDEADYYCQSADSSGTYPVVFGGGTKLTVL

SEQ ID NO: 2123 - protein, 11 aa, Artificial Sequence
  Description of Artificial Sequence: Synthetic light chain variable region CDR L1
SGDALPKQYAY

SEQ ID NO: 2124 - DNA, 33 bp, Artificial Sequence
  Description of Artificial Sequence: Synthetic light chain variable region CDR L1
tctggagatgcattgccaaagcaatatgcttat

SEQ ID NO: 2125 - protein, 7 aa, Artificial Sequence
  Description of Artificial Sequence: Synthetic light chain variable region CDR L2
KDSERPS

SEQ ID NO: 2126 - DNA, 21 bp, Artificial Sequence
  Description of Artificial Sequence: Synthetic light chain variable region CDR L2
aaagacagtgagaggccctca

SEQ ID NO: 2127 - protein, 12 aa, Artificial Sequence
  Description of Artificial Sequence: Synthetic light chain variable region CDR L3
QSADSSGTYPVV

SEQ ID NO: 2128 - DNA, 36 bp, Artificial Sequence
  Description of Artificial Sequence: Synthetic light chain variable region CDR L3
caatcagcagacagcagtggtacttatccggtggtg

SEQ ID NO: 2129 - DNA, 366 bp, Artificial Sequence
  Description of Artificial Sequence: Synthetic heavy chain variable region
gaggtgcagctggtggagtcgggcccaggactggtggagccttcggagaccctgtccctcacctgcactgtctctggtgcctccatcagcagtagtgaatactactggggctggatccgccagcccccagggaaggggctggagtggattgggactttctattatagtgggagcacctactacaacccgtccctcaagagtcgagtcaccatatccgaagacacgtccaagaatcagctctccctgaagttgagctctgtgaccgccgtagacacggctgtgtattactgtgcgagacacagcagatccgacgtccggaactacttcgacccctggggccagggaaccctggtcaccgtctcctca

SEQ ID NO: 2130 - protein, 122 aa, Artificial Sequence
  Description of Artificial Sequence: Synthetic heavy chain variable region
EVQLVESGPGLVEPSETLSLTCTVSGASISSSEYYWGWIRQPPGKGLEWIGTFYYSGSTYYNPSLKSRVTISEDTSKNQLSLKLSSVTAVDTAVYYCARHSRSDVRNYFDPWGQGTLVTVSS

SEQ ID NO: 2131 - protein, 11 aa, Artificial Sequence
  Description of Artificial Sequence: Synthetic heavy chain variable region CDR H1
ASISSSEYYWG

SEQ ID NO: 2132 - DNA, 33 bp, Artificial Sequence
  Description of Artificial Sequence: Synthetic heavy chain variable region CDR H1
gcctccatcagcagtagtgaatactactggggc

SEQ ID NO: 2133 - protein, 16 aa, Artificial Sequence
  Description of Artificial Sequence: Synthetic heavy chain variable region CDR H2
TFYYSGSTYYNPSLKS

SEQ ID NO: 2134 - DNA, 48 bp, Artificial Sequence
  Description of Artificial Sequence: Synthetic heavy chain variable region CDR H2
actttctattatagtgggagcacctactacaacccgtccctcaagagt

SEQ ID NO: 2135 - protein, 14 aa, Artificial Sequence
  Description of Artificial Sequence: Synthetic heavy chain variable region CDR H3
ARHSRSDVRNYFDP

SEQ ID NO: 2136 - DNA, 42 bp, Artificial Sequence
  Description of Artificial Sequence: Synthetic heavy chain variable region CDR H3
gcgagacacagcagatccgacgtccggaactacttcgacccc

SEQ ID NO: 2137 - DNA, 321 bp, Artificial Sequence
  Description of Artificial Sequence: Synthetic light chain variable region
gaaattgtgatgacacagtctccatcctccctgtctgcagctgtaggagacagcgtcaccatcacttgccgggcaagtcagagcatcagcaactatttaaattggtatcagcagaaatcagggaaagcccctaagctcctgatctatgctgcatccagtttgcaaagtggggtcccatcaaggttcagtggcagtggatctgggacagatttcactctcactatcagcagtctgcaacctgaagatttttcaacttactactgtcaacagagtcacagtacccccgccacttttggcctggggaccaaagtggatatcaaa

SEQ ID NO: 2138 - protein, 107 aa, Artificial Sequence
  Description of Artificial Sequence: Synthetic light chain variable region
EIVMTQSPSSLSAAVGDSVTITCRASQSISNYLNWYQQKSGKAPKLLIYAASSLQSGVPSRFSGSGSGTDFTLTISSLQPEDFSTYYCQQSHSTPATFGLGTKVDIK

SEQ ID NO: 2139 - protein, 11 aa, Artificial Sequence
  Description of Artificial Sequence: Synthetic light chain variable region CDR L1
RASQSISNYLN

SEQ ID NO: 2140 - DNA, 33 bp, Artificial Sequence
  Description of Artificial Sequence: Synthetic light chain variable region CDR L1
cgggcaagtcagagcatcagcaactatttaaat

SEQ ID NO: 2141 - protein, 7 aa, Artificial Sequence
  Description of Artificial Sequence: Synthetic light chain variable region CDR L2
AASSLQS

SEQ ID NO: 2142 - DNA, 21 bp, Artificial Sequence
  Description of Artificial Sequence: Synthetic light chain variable region CDR L2
gctgcatccagtttgcaaagt

SEQ ID NO: 2143 - protein, 9 aa, Artificial Sequence
  Description of Artificial Sequence: Synthetic light chain variable region CDR L3
QQSHSTPAT

SEQ ID NO: 2144 - DNA, 27 bp, Artificial Sequence
  Description of Artificial Sequence: Synthetic light chain variable region CDR L3
caacagagtcacagtacccccgccact

SEQ ID NO: 2145 - DNA, 366 bp, Artificial Sequence; identical to SEQ ID NO: 561
  Description of Artificial Sequence: Synthetic Heavy chain variable region ('HC') nucleic acid sequence

SEQ ID NO: 2146 - protein, 122 aa, Artificial Sequence; identical to SEQ ID NO: 562
  Description of Artificial Sequence: Synthetic Heavy chain variable region ('HC') amino acid sequence

SEQ ID NO: 2147 - protein, 9 aa, Artificial Sequence
  Description of Artificial Sequence: Synthetic Heavy chain variable region CDR H1 ('H1') amino acid sequence
FSFRSYSMN

SEQ ID NO: 2148 - protein, 17 aa, Artificial Sequence
  Description of Artificial Sequence: Synthetic Heavy chain variable region CDR H2 ('H2') amino acid sequence
SISSSSNYINYADSVKG

SEQ ID NO: 2149 - protein, 15 aa, Artificial Sequence
  Description of Artificial Sequence: Synthetic Heavy chain variable region CDR H3 ('H3') amino acid sequence
ARDLLPVERGPAFDI

SEQ ID NO: 2150 - DNA, 333 bp, Artificial Sequence
  Description of Artificial Sequence: Synthetic Light chain variable region('LC') nucleic acid sequence
tcctacgagctgacacagccaccctcagtgtctggggccccagggcagagggtcactatctcctgcactgggagcagctccaacatcgggaggggttatgatgtacactggttccagcagcttccaggagcagcccccaaactcctcatctatgctaacagcaatcggccctcaggggtccctgaccgattctctggctccaagtctggcacctcagcctccctggccatcactgggctccaggctgaggatgaggctgattattactgccagtcctatgacagcagactgggtggttcggtattcggcggagggaccaaggtgaccgtccta

SEQ ID NO: 2151 - protein, 111 aa, Artificial Sequence
  Description of Artificial Sequence: Synthetic Light chain variable region ('LC') amino acid sequence
SYELTQPPSVSGAPGQRVTISCTGSSSNIGRGYDVHWFQQLPGAAPKLLIYANSNRPSGVPDRFSGSKSGTSASLAITGLQAEDEADYYCQSYDSRLGGSVFGGGTKVTVL

SEQ ID NO: 2152 - protein, 14 aa, Artificial Sequence
  Description of Artificial Sequence: Synthetic Light chain variable region CDR L1 ('L1') amino acid sequence
TGSSSNIGRGYDVH

SEQ ID NO: 2153 - protein, 7 aa, Artificial Sequence
  Description of Artificial Sequence: Synthetic Light chain variable region CDR L2 ('L2') amino acid sequence
ANSNRPS

SEQ ID NO: 2154 - protein, 11 aa, Artificial Sequence
  Description of Artificial Sequence: Synthetic Light chain variable region CDR L3 ('L3') amino acid sequence
QSYDSRLGGSV

SEQ ID NO: 2155 - DNA, 366 bp, Artificial Sequence; identical to SEQ ID NO: 561
  Description of Artificial Sequence: Synthetic Heavy chain variable region ('HC') nucleic acid sequence

SEQ ID NO: 2156 - protein, 122 aa, Artificial Sequence; identical to SEQ ID NO: 562
  Description of Artificial Sequence: Synthetic Heavy chain variable region ('HC') amino acid sequence

SEQ ID NO: 2157 - protein, 9 aa, Artificial Sequence
  Description of Artificial Sequence: Synthetic Heavy chain variable region CDR H1 ('H1') amino acid sequence
FSFRSYSMN

SEQ ID NO: 2158 - protein, 17 aa, Artificial Sequence
  Description of Artificial Sequence: Synthetic Heavy chain variable region CDR H2 ('H2') amino acid sequence
SISSSSNYINYADSVKG

SEQ ID NO: 2159 - protein, 15 aa, Artificial Sequence
  Description of Artificial Sequence: Synthetic Heavy chain variable region CDR H3 ('H3') amino acid sequence
ARDLLPVERGPAFDI

SEQ ID NO: 2160 - DNA, 333 bp, Artificial Sequence
  Description of Artificial Sequence: Synthetic Light chain variable region('LC') nucleic acid sequence
tcctatgagctgacacagccaccctcagtgtctggggccccagggcagagggtcaccatctcctgcactgggagcagctccaacatcggggcaggttatgatgtacactggttccagcagcttccaggagcagcccccaaactcctcatctatcgtaacagcaatcggccctcaggggtccctgaccgattctctggctccaagtctggcacctcagcctccctggccatcactgggctccaggctgaggatgaggctgattattactgccagtcctatgacagcagactgggtggttcgaatttcggcggagggaccaaggtgaccgtccta

SEQ ID NO: 2161 - protein, 111 aa, Artificial Sequence
  Description of Artificial Sequence: Synthetic Light chain variable region ('LC') amino acid sequence
SYELTQPPSVSGAPGQRVTISCTGSSSNIGAGYDVHWFQQLPGAAPKLLIYRNSNRPSGVPDRFSGSKSGTSASLAITGLQAEDEADYYCQSYDSRLGGSNFGGGTKVTVL

SEQ ID NO: 2162 - protein, 14 aa, Artificial Sequence
  Description of Artificial Sequence: Synthetic Light chain variable region CDR L1 ('L1') amino acid sequence
TGSSSNIGAGYDVH

SEQ ID NO: 2163 - protein, 7 aa, Artificial Sequence
  Description of Artificial Sequence: Synthetic Light chain variable region CDR L2 ('L2') amino acid sequence
RNSNRPS

SEQ ID NO: 2164 - protein, 11 aa, Artificial Sequence
  Description of Artificial Sequence: Synthetic Light chain variable region CDR L3 ('L3') amino acid sequence
QSYDSRLGGSN

SEQ ID NO: 2165 - DNA, 366 bp, Artificial Sequence
  Description of Artificial Sequence: Synthetic Heavy chain variable region ('HC') nucleic acid sequence
gaggtgcagctggtggagtctgggggaggcctggtcaagcctgggggggccctgagactctcctgtgcagcctctggattcagcttcaggagctatagcatgaactgggtccgccaggctccagggaaggggctggagtgggtctcatccattagtgctagtagtaattacataaactacgcagactcagtgaagggccgattcagcatctccagagacaacgccaagaactcactgtatctgcaaatgaacagcctgagagccgaggacacggctgtctattactgtgcgagagatttgttacccgtcgagcggggtcccgcttttgatatctggggccaagggacaatggtcaccgtctcttca

SEQ ID NO: 2166 - protein, 122 aa, Artificial Sequence
  Description of Artificial Sequence: Synthetic Heavy chain variable region ('HC') amino acid sequence
EVQLVESGGGLVKPGGALRLSCAASGFSFRSYSMNWVRQAPGKGLEWVSSISASSNYINYADSVKGRFSISRDNAKNSLYLQMNSLRAEDTAVYYCARDLLPVERGPAFDIWGQGTMVTVSS

SEQ ID NO: 2167 - protein, 9 aa, Artificial Sequence
  Description of Artificial Sequence: Synthetic Heavy chain variable region CDR H1 ('H1') amino acid sequence
FSFRSYSMN

SEQ ID NO: 2168 - protein, 17 aa, Artificial Sequence
  Description of Artificial Sequence: Synthetic Heavy chain variable region CDR H2 ('H2') amino acid sequence
SISASSNYINYADSVKG

SEQ ID NO: 2169 - protein, 15 aa, Artificial Sequence
  Description of Artificial Sequence: Synthetic Heavy chain variable region CDR H3 ('H3') amino acid sequence
ARDLLPVERGPAFDI

SEQ ID NO: 2170 - DNA, 333 bp, Artificial Sequence; identical to SEQ ID NO: 569
  Description of Artificial Sequence: Synthetic Light chain variable region('LC') nucleic acid sequence

SEQ ID NO: 2171 - protein, 111 aa, Artificial Sequence; identical to SEQ ID NO: 570
  Description of Artificial Sequence: Synthetic Light chain variable region ('LC') amino acid sequence

SEQ ID NO: 2172 - protein, 14 aa, Artificial Sequence
  Description of Artificial Sequence: Synthetic Light chain variable region CDR L1 ('L1') amino acid sequence
TGSSSNIGAGYDVH

SEQ ID NO: 2173 - protein, 7 aa, Artificial Sequence
  Description of Artificial Sequence: Synthetic Light chain variable region CDR L2 ('L2') amino acid sequence
ANSNRPS

SEQ ID NO: 2174 - protein, 11 aa, Artificial Sequence
  Description of Artificial Sequence: Synthetic Light chain variable region CDR L3 ('L3') amino acid sequence
QSYDSRLGGSV

SEQ ID NO: 2175 - DNA, 366 bp, Artificial Sequence
  Description of Artificial Sequence: Synthetic Heavy chain variable region ('HC') nucleic acid sequence
gaggtgcagctggtggagtctgggggaggcctggtcaagcctgggggggccctgagactctcctgtgcagcctctggattcagcttcaggagctatagcatgaactgggtccgccaggctccagggaaggggctggagtgggtctcatccattagtagtagtagtacttacataaactacgcagactcagtgaagggccgattcagcatctccagagacaacgccaagaactcactgtatctgcaaatgaacagcctgagagccgaggacacggctgtctattactgtgcgagagatttgagtcccgtcgagcggggtcccgcttttgatatctggggccaagggacaatggtcaccgtctcttca

SEQ ID NO: 2176 - protein, 122 aa, Artificial Sequence
  Description of Artificial Sequence: Synthetic Heavy chain variable region ('HC') amino acid sequence
EVQLVESGGGLVKPGGALRLSCAASGFSFRSYSMNWVRQAPGKGLEWVSSISSSSTYINYADSVKGRFSISRDNAKNSLYLQMNSLRAEDTAVYYCARDLSPVERGPAFDIWGQGTMVTVSS

SEQ ID NO: 2177 - protein, 9 aa, Artificial Sequence
  Description of Artificial Sequence: Synthetic Heavy chain variable region CDR H1 ('H1') amino acid sequence
FSFRSYSMN

SEQ ID NO: 2178 - protein, 17 aa, Artificial Sequence
  Description of Artificial Sequence: Synthetic Heavy chain variable region CDR H2 ('H2') amino acid sequence
SISSSSTYINYADSVKG

SEQ ID NO: 2179 - protein, 15 aa, Artificial Sequence
  Description of Artificial Sequence: Synthetic Heavy chain variable region CDR H3 ('H3') amino acid sequence
ARDLSPVERGPAFDI

SEQ ID NO: 2180 - DNA, 333 bp, Artificial Sequence; identical to SEQ ID NO: 569
  Description of Artificial Sequence: Synthetic Light chain variable region('LC') nucleic acid sequence

SEQ ID NO: 2181 - protein, 111 aa, Artificial Sequence; identical to SEQ ID NO: 570
  Description of Artificial Sequence: Synthetic Light chain variable region ('LC') amino acid sequence

SEQ ID NO: 2182 - protein, 14 aa, Artificial Sequence
  Description of Artificial Sequence: Synthetic Light chain variable region CDR L1 ('L1') amino acid sequence
TGSSSNIGAGYDVH

SEQ ID NO: 2183 - protein, 7 aa, Artificial Sequence
  Description of Artificial Sequence: Synthetic Light chain variable region CDR L2 ('L2') amino acid sequence
ANSNRPS

SEQ ID NO: 2184 - protein, 11 aa, Artificial Sequence
  Description of Artificial Sequence: Synthetic Light chain variable region CDR L3 ('L3') amino acid sequence
QSYDSRLGGSV

SEQ ID NO: 2185 - DNA, 366 bp, Artificial Sequence; identical to SEQ ID NO: 2165
  Description of Artificial Sequence: Synthetic Heavy chain variable region ('HC') nucleic acid sequence

SEQ ID NO: 2186 - protein, 122 aa, Artificial Sequence; identical to SEQ ID NO: 2166
  Description of Artificial Sequence: Synthetic Heavy chain variable region ('HC') amino acid sequence

SEQ ID NO: 2187 - protein, 9 aa, Artificial Sequence
  Description of Artificial Sequence: Synthetic Heavy chain variable region CDR H1 ('H1') amino acid sequence
FSFRSYSMN

SEQ ID NO: 2188 - protein, 17 aa, Artificial Sequence
  Description of Artificial Sequence: Synthetic Heavy chain variable region CDR H2 ('H2') amino acid sequence
SISASSNYINYADSVKG

SEQ ID NO: 2189 - protein, 15 aa, Artificial Sequence
  Description of Artificial Sequence: Synthetic Heavy chain variable region CDR H3 ('H3') amino acid sequence
ARDLLPVERGPAFDI

SEQ ID NO: 2190 - DNA, 333 bp, Artificial Sequence; identical to SEQ ID NO: 2150
  Description of Artificial Sequence: Synthetic Light chain variable region('LC') nucleic acid sequence

SEQ ID NO: 2191 - protein, 111 aa, Artificial Sequence; identical to SEQ ID NO: 2151
  Description of Artificial Sequence: Synthetic Light chain variable region ('LC') amino acid sequence

SEQ ID NO: 2192 - protein, 14 aa, Artificial Sequence
  Description of Artificial Sequence: Synthetic Light chain variable region CDR L1 ('L1') amino acid sequence
TGSSSNIGRGYDVH

SEQ ID NO: 2193 - protein, 7 aa, Artificial Sequence
  Description of Artificial Sequence: Synthetic Light chain variable region CDR L2 ('L2') amino acid sequence
ANSNRPS

SEQ ID NO: 2194 - protein, 11 aa, Artificial Sequence
  Description of Artificial Sequence: Synthetic Light chain variable region CDR L3 ('L3') amino acid sequence
QSYDSRLGGSV

SEQ ID NO: 2195 - DNA, 366 bp, Artificial Sequence; identical to SEQ ID NO: 2165
  Description of Artificial Sequence: Synthetic Heavy chain variable region ('HC') nucleic acid sequence

SEQ ID NO: 2196 - protein, 122 aa, Artificial Sequence; identical to SEQ ID NO: 2166
  Description of Artificial Sequence: Synthetic Heavy chain variable region ('HC') amino acid sequence

SEQ ID NO: 2197 - protein, 9 aa, Artificial Sequence
  Description of Artificial Sequence: Synthetic Heavy chain variable region CDR H1 ('H1') amino acid sequence
FSFRSYSMN

SEQ ID NO: 2198 - protein, 17 aa, Artificial Sequence
  Description of Artificial Sequence: Synthetic Heavy chain variable region CDR H2 ('H2') amino acid sequence
SISASSNYINYADSVKG

SEQ ID NO: 2199 - protein, 15 aa, Artificial Sequence
  Description of Artificial Sequence: Synthetic Heavy chain variable region CDR H3 ('H3') amino acid sequence
ARDLLPVERGPAFDI

SEQ ID NO: 2200 - DNA, 333 bp, Artificial Sequence; identical to SEQ ID NO: 2160
  Description of Artificial Sequence: Synthetic Light chain variable region('LC') nucleic acid sequence

SEQ ID NO: 2201 - protein, 111 aa, Artificial Sequence; identical to SEQ ID NO: 2161
  Description of Artificial Sequence: Synthetic Light chain variable region ('LC') amino acid sequence

SEQ ID NO: 2202 - protein, 14 aa, Artificial Sequence
  Description of Artificial Sequence: Synthetic Light chain variable region CDR L1 ('L1') amino acid sequence
TGSSSNIGAGYDVH

SEQ ID NO: 2203 - protein, 7 aa, Artificial Sequence
  Description of Artificial Sequence: Synthetic Light chain variable region CDR L2 ('L2') amino acid sequence
RNSNRPS

SEQ ID NO: 2204 - protein, 11 aa, Artificial Sequence
  Description of Artificial Sequence: Synthetic Light chain variable region CDR L3 ('L3') amino acid sequence
QSYDSRLGGSN

SEQ ID NO: 2205 - DNA, 366 bp, Artificial Sequence; identical to SEQ ID NO: 2175
  Description of Artificial Sequence: Synthetic Heavy chain variable region ('HC') nucleic acid sequence

SEQ ID NO: 2206 - protein, 122 aa, Artificial Sequence; identical to SEQ ID NO: 2176
  Description of Artificial Sequence: Synthetic Heavy chain variable region ('HC') amino acid sequence

SEQ ID NO: 2207 - protein, 9 aa, Artificial Sequence
  Description of Artificial Sequence: Synthetic Heavy chain variable region CDR H1 ('H1') amino acid sequence
FSFRSYSMN

SEQ ID NO: 2208 - protein, 17 aa, Artificial Sequence
  Description of Artificial Sequence: Synthetic Heavy chain variable region CDR H2 ('H2') amino acid sequence
SISSSSTYINYADSVKG

SEQ ID NO: 2209 - protein, 15 aa, Artificial Sequence
  Description of Artificial Sequence: Synthetic Heavy chain variable region CDR H3 ('H3') amino acid sequence
ARDLSPVERGPAFDI

SEQ ID NO: 2210 - DNA, 333 bp, Artificial Sequence; identical to SEQ ID NO: 2150
  Description of Artificial Sequence: Synthetic Light chain variable region('LC') nucleic acid sequence

SEQ ID NO: 2211 - protein, 111 aa, Artificial Sequence; identical to SEQ ID NO: 2151
  Description of Artificial Sequence: Synthetic Light chain variable region ('LC') amino acid sequence

SEQ ID NO: 2212 - protein, 14 aa, Artificial Sequence
  Description of Artificial Sequence: Synthetic Light chain variable region CDR L1 ('L1') amino acid sequence
TGSSSNIGRGYDVH

SEQ ID NO: 2213 - protein, 7 aa, Artificial Sequence
  Description of Artificial Sequence: Synthetic Light chain variable region CDR L2 ('L2') amino acid sequence
ANSNRPS

SEQ ID NO: 2214 - protein, 11 aa, Artificial Sequence
  Description of Artificial Sequence: Synthetic Light chain variable region CDR L3 ('L3') amino acid sequence
QSYDSRLGGSV

SEQ ID NO: 2215 - DNA, 366 bp, Artificial Sequence; identical to SEQ ID NO: 2175
  Description of Artificial Sequence: Synthetic Heavy chain variable region ('HC') nucleic acid sequence

SEQ ID NO: 2216 - protein, 122 aa, Artificial Sequence; identical to SEQ ID NO: 2176
  Description of Artificial Sequence: Synthetic Heavy chain variable region ('HC') amino acid sequence

SEQ ID NO: 2217 - protein, 9 aa, Artificial Sequence
  Description of Artificial Sequence: Synthetic Heavy chain variable region CDR H1 ('H1') amino acid sequence
FSFRSYSMN

SEQ ID NO: 2218 - protein, 17 aa, Artificial Sequence
  Description of Artificial Sequence: Synthetic Heavy chain variable region CDR H2 ('H2') amino acid sequence
SISSSSTYINYADSVKG

SEQ ID NO: 2219 - protein, 15 aa, Artificial Sequence
  Description of Artificial Sequence: Synthetic Heavy chain variable region CDR H3 ('H3') amino acid sequence
ARDLSPVERGPAFDI

SEQ ID NO: 2220 - DNA, 333 bp, Artificial Sequence; identical to SEQ ID NO: 2160
  Description of Artificial Sequence: Synthetic Light chain variable region('LC') nucleic acid sequence

SEQ ID NO: 2221 - protein, 111 aa, Artificial Sequence; identical to SEQ ID NO: 2161
  Description of Artificial Sequence: Synthetic Light chain variable region ('LC') amino acid sequence

SEQ ID NO: 2222 - protein, 14 aa, Artificial Sequence
  Description of Artificial Sequence: Synthetic Light chain variable region CDR L1 ('L1') amino acid sequence
TGSSSNIGAGYDVH

SEQ ID NO: 2223 - protein, 7 aa, Artificial Sequence
  Description of Artificial Sequence: Synthetic Light chain variable region CDR L2 ('L2') amino acid sequence
RNSNRPS

SEQ ID NO: 2224 - protein, 11 aa, Artificial Sequence
  Description of Artificial Sequence: Synthetic Light chain variable region CDR L3 ('L3') amino acid sequence
QSYDSRLGGSN

SEQ ID NO: 2225 - protein, 17 aa, Artificial Sequence
  Description of Artificial Sequence: Synthetic degenerate consensus sequence for antibody CDRs
  MOD_RES (4)..(4): S or A
  MOD_RES (7)..(7): N or T
SISXSSXYINYADSVKG

SEQ ID NO: 2226 - protein, 15 aa, Artificial Sequence
  Description of Artificial Sequence: Synthetic degenerate consensus sequence for antibody CDRs
  MOD_RES (5)..(5): S or L
ARDLXPVERGPAFDI

SEQ ID NO: 2227 - protein, 14 aa, Artificial Sequence
  Description of Artificial Sequence: Synthetic degenerate consensus sequence for antibody CDRs
  MOD_RES (9)..(9): A or R
TGSSSNIGXGYDVH

SEQ ID NO: 2228 - protein, 7 aa, Artificial Sequence
  Description of Artificial Sequence: Synthetic degenerate consensus sequence for antibody CDRs
  MOD_RES (1)..(1): A or R
XNSNRPS

SEQ ID NO: 2229 - protein, 11 aa, Artificial Sequence
  Description of Artificial Sequence: Synthetic degenerate consensus sequence for antibody CDRs
  MOD_RES (11)..(11): V or N
QSYDSRLGGSX

What is claimed is:

1. An isolated antibody or an antigen-binding fragment thereof comprising:
    a CDRH1 comprising the amino acid sequence FSFR-SYSMN (SEQ ID NO: 563);
    a CDRH2 comprising the amino acid sequence SIS-Xaa1-SS-Xaa2-YINYADSVKG (SEQ ID NO: 2225), wherein Xaa1 is S or A and wherein Xaa2 is N or T;
    a CDRH3 comprising the amino acid sequence ARDL-Xaa3-PVERGPAFDI (SEQ ID NO: 2226), wherein Xaa3 is S or L;
    a CDRL1 comprising the amino acid sequence TGSSSNIG-Xaa4-GYDVH (SEQ ID NO: 2227), wherein Xaa4 is A or R;
    a CDRL2 comprising the amino acid sequence Xaa5-NSNRPS (SEQ ID NO: 2228), wherein Xaa5 is A or R; and
    a CDRL3 comprising the amino acid sequence QSYDSRLGGS-Xaa6 (SEQ ID NO: 2229), wherein Xaa6 is V or N; and
    wherein the antibody or antigen binding fragment thereof is not Antibody 267.

2. The isolated antibody or antigen-binding fragment thereof of claim 1, wherein:
    a) the CDRH1 comprises the amino acid sequence of SEQ ID NO: 2147, the CDRH2 comprises the amino acid sequence of SEQ ID NO: 2148, the CDRH3 comprises the amino acid sequence of SEQ ID NO: 2149, the CDRL1 comprises the amino acid sequence of SEQ ID NO: 2152, the CDRL2 comprises the amino acid sequence of SEQ ID NO: 2153, and the CDRL3 comprises the amino acid sequence of SEQ ID NO: 2154;
    b) the CDRH1 comprises the amino acid sequence of SEQ ID NO: 2157, the CDRH2 comprises the amino acid sequence of SEQ ID NO: 2158, the CDRH3 comprises the amino acid sequence of SEQ ID NO: 2159, the CDRL1 comprises the amino acid sequence of SEQ ID NO: 2162, the CDRL2 comprises the amino acid sequence of SEQ ID NO: 2163, and the CDRL3 comprises the amino acid sequence of SEQ ID NO: 2164;
    c) the CDRH1 comprises the amino acid sequence of SEQ ID NO: 2167, the CDRH2 comprises the amino acid sequence of SEQ ID NO: 2168, the CDRH3 comprises the amino acid sequence of SEQ ID NO: 2169, the CDRL1 comprises the amino acid sequence of SEQ ID NO: 2172, the CDRL2 comprises the amino acid sequence of SEQ ID NO: 2173, and the CDRL3 comprises the amino acid sequence of SEQ ID NO: 2174;
    d) the CDRH1 comprises the amino acid sequence of SEQ ID NO: 2177, the CDRH2 comprises the amino acid sequence of SEQ ID NO: 2178, the CDRH3 comprises the amino acid sequence of SEQ ID NO: 2179, the CDRL1 comprises the amino acid sequence of SEQ ID NO: 2182, the CDRL2 comprises the amino acid sequence of SEQ ID NO: 2183, and the CDRL3 comprises the amino acid sequence of SEQ ID NO: 2184;
    e) the CDRH1 comprises the amino acid sequence of SEQ ID NO: 2187, the CDRH2 comprises the amino acid sequence of SEQ ID NO: 2188, the CDRH3 comprises the amino acid sequence of SEQ ID NO: 2189, the CDRL1 comprises the amino acid sequence of SEQ ID NO: 2192, the CDRL2 comprises the amino acid sequence of SEQ ID NO: 2193, and the CDRL3 comprises the amino acid sequence of SEQ ID NO: 2194;

f) the CDRH1 comprises the amino acid sequence of SEQ ID NO: 2197, the CDRH2 comprises the amino acid sequence of SEQ ID NO: 2198, the CDRH3 comprises the amino acid sequence of SEQ ID NO: 2199, the CDRL1 comprises the amino acid sequence of SEQ ID NO: 2202, the CDRL2 comprises the amino acid sequence of SEQ ID NO: 2203, and the CDRL3 comprises the amino acid sequence of SEQ ID NO: 2204;

g) the CDRH1 comprises the amino acid sequence of SEQ ID NO: 2207, the CDRH2 comprises the amino acid sequence of SEQ ID NO: 2208, the CDRH3 comprises the amino acid sequence of SEQ ID NO: 2209, the CDRL1 comprises the amino acid sequence of SEQ ID NO: 2212, the CDRL2 comprises the amino acid sequence of SEQ ID NO: 2213, and the CDRL3 comprises the amino acid sequence of SEQ ID NO: 2214; or h) the CDRH1 comprises the amino acid sequence of SEQ ID NO: 2217, the CDRH2 comprises the amino acid sequence of SEQ ID NO: 2218, the CDRH3 comprises the amino acid sequence of SEQ ID NO: 2219, the CDRL1 comprises the amino acid sequence of SEQ ID NO: 2222, the CDRL2 comprises the amino acid sequence of SEQ ID NO: 2223, and the CDRL3 comprises the amino acid sequence of SEQ ID NO: 2224.

3. The isolated antibody or antigen-binding fragment thereof of claim 1, wherein the antibody or antigen-binding fragment thereof comprises:
a) a heavy chain (HC) amino acid sequence of SEQ ID NO: 2146 and a light chain (LC) amino acid sequence of SEQ ID NO: 2151;
b) a heavy chain (HC) amino acid sequence of SEQ ID NO: 2156 and a light chain (LC) amino acid sequence of SEQ ID NO: 2161;
c) a heavy chain (HC) amino acid sequence of SEQ ID NO: 2166 and a light chain (LC) amino acid sequence of SEQ ID NO: 2171;
d) a heavy chain (HC) amino acid sequence of SEQ ID NO: 2176 and a light chain (LC) amino acid sequence of SEQ ID NO: 2181;
e) a heavy chain (HC) amino acid sequence of SEQ ID NO: 2186 and a light chain (LC) amino acid sequence of SEQ ID NO: 2191;
f) a heavy chain (HC) amino acid sequence of SEQ ID NO: 2196 and a light chain (LC) amino acid sequence of SEQ ID NO: 2201;
g) a heavy chain (HC) amino acid sequence of SEQ ID NO: 2206 and a light chain (LC) amino acid sequence of SEQ ID NO: 2211; or
h) a heavy chain (HC) amino acid sequence of SEQ ID NO: 2216 and a light chain (LC) amino acid sequence of SEQ ID NO: 2221.

4. A pharmaceutical composition comprising:
one or more of the isolated antibodies or antigen-binding fragments thereof according to claim 1; and
a pharmaceutically acceptable carrier and/or excipient.

5. A method of treating a Respiratory Syncytial Virus (RSV) infection, or at least one symptom associated with RSV infection, comprising administering to a patient in need thereof or suspected of being in need thereof one or more antibodies or antigen-binding fragments thereof according to claim 1 such that the RSV infection is treated, or the at least one symptom associated with RSV infection is treated, alleviated, or reduced in severity.

6. The method according to claim 5, wherein the method further comprises administering to the patient a second therapeutic agent.

7. The method according to claim 6, wherein the second therapeutic agent is selected from the group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

8. A method comprising a step of:
administering the pharmaceutical composition according to claim 4 to a patient suffering from infection with respiratory syncytial virus (RSV).

9. An isolated antibody or an antigen-binding fragment thereof that is a variant of Antibody 267, wherein:
(i) the isolated antibody or antigen-binding fragment thereof comprises:
a CDRH1 comprising the amino acid sequence FSFRSYSMN (SEQ ID NO: 563);
a CDRH2 comprising the amino acid sequence SIS-Xaa1-SS-Xaa2-YINYADSVKG (SEQ ID NO: 2225), wherein Xaa1 is S or A and wherein Xaa2 is N or T;
a CDRH3 comprising the amino acid sequence ARDL-Xaa3-PVERGPAFDI (SEQ ID NO: 2226), wherein Xaa3 is S or L;
a CDRL1 comprising the amino acid sequence TGSSSNIG-Xaa4-GYDVH (SEQ ID NO: 2227), wherein Xaa4 is A or R;
a CDRL2 comprising the amino acid sequence Xaa5-NSNRPS (SEQ ID NO: 2228), wherein Xaa5 is A or R; and
a CDRL3 comprising the amino acid sequence QSYDSRLGGS-Xaa6 (SEQ ID NO: 2229), wherein Xaa6 is V or N; and
(ii) wherein Antibody 267 has a light chain variable region as set forth in SEQ ID NO: 570 and a heavy chain variable region as set forth in SEQ ID NO: 562.

* * * * *